US011123379B2

(12) United States Patent
Mulder et al.

(10) Patent No.: US 11,123,379 B2
(45) Date of Patent: Sep. 21, 2021

(54) COMPOSITIONS COMPRISING BACTERIAL STRAINS

(71) Applicant: 4D Pharma Research Limited, Aberdeen (GB)

(72) Inventors: Imke Elisabeth Mulder, Aberdeen (GB); Anna Ettorre, Aberdeen (GB); Suaad Ahmed, Aberdeen (GB); Parthena Fotiadou, Aberdeen (GB); Samantha Yuille, Aberdeen (GB); Helene Savignac, Aberdeen (GB)

(73) Assignee: 4D Pharma Research Limited, Aberdeen (GB)

( * ) Notice: Subject to any disclaimer, the term of this patent is extended or adjusted under 35 U.S.C. 154(b) by 0 days.

(21) Appl. No.: 16/713,969

(22) Filed: Dec. 13, 2019

(65) Prior Publication Data

US 2020/0179459 A1    Jun. 11, 2020

Related U.S. Application Data

(63) Continuation of application No. PCT/EP2018/065808, filed on Jun. 14, 2018.

(30) Foreign Application Priority Data

Jun. 14, 2017  (GB) ...................................... 1709466
Jun. 15, 2017  (GB) ...................................... 1709533

(51) Int. Cl.
*A61K 35/74*  (2015.01)
*A61K 9/00*   (2006.01)
*A61K 9/19*   (2006.01)

(52) U.S. Cl.
CPC ............ *A61K 35/74* (2013.01); *A61K 9/0053* (2013.01); *A61K 9/19* (2013.01)

(58) Field of Classification Search
CPC ......... A61K 35/74; A61K 9/0053; A61K 9/19
See application file for complete search history.

(56) References Cited

U.S. PATENT DOCUMENTS

| | | | |
|---|---|---|---|
| 3,817,837 A | 6/1974 | Rubenstein et al. | |
| 3,850,752 A | 11/1974 | Schuurs et al. | |
| 3,939,350 A | 2/1976 | Kronick et al. | |
| 3,996,345 A | 12/1976 | Ullman et al. | |
| 4,275,149 A | 6/1981 | Litman et al. | |
| 4,277,437 A | 7/1981 | Maggio | |
| 4,366,241 A | 12/1982 | Tom et al. | |
| 4,683,202 A | 7/1987 | Mullis | |
| 4,816,567 A | 3/1989 | Cabilly et al. | |
| 5,589,168 A | 12/1996 | Allen et al. | |
| 5,599,795 A | 2/1997 | McCann et al. | |
| 5,674,707 A | 10/1997 | Hintz et al. | |
| 5,741,665 A | 4/1998 | Kato et al. | |
| 5,925,657 A | 7/1999 | Seed et al. | |
| 5,951,977 A | 9/1999 | Nisbet et al. | |
| 6,348,452 B1 | 2/2002 | Brown et al. | |
| 6,468,964 B1 | 10/2002 | Rowe et al. | |
| 6,645,530 B1 | 11/2003 | Borody | |
| 7,101,565 B2 | 9/2006 | Monte | |
| 7,485,325 B2 | 2/2009 | Swain | |
| 7,625,704 B2 | 12/2009 | Fredricks et al. | |
| 7,749,494 B2 | 7/2010 | Renaud et al. | |
| 7,998,474 B2 | 8/2011 | Kelly | |
| 8,197,805 B2 | 6/2012 | Lin et al. | |
| 8,287,932 B2 | 10/2012 | Rosales et al. | |
| 8,460,648 B2 | 6/2013 | Borody | |
| 8,557,233 B2 | 10/2013 | MacSharry et al. | |
| 9,011,834 B1 | 4/2015 | McKenzie et al. | |
| 9,028,841 B2 * | 5/2015 | Henn .................... A23L 33/135 424/247.1 |
| 9,314,489 B2 | 4/2016 | Kelly et al. | |
| 9,371,510 B2 | 6/2016 | Moore | |
| 9,376,473 B2 | 6/2016 | Gleiberman et al. | |
| 9,539,293 B2 | 1/2017 | Kelly et al. | |
| 9,610,307 B2 | 4/2017 | Berry et al. | |
| 9,662,381 B2 | 5/2017 | Honda et al. | |
| 9,796,762 B2 | 10/2017 | Kelly et al. | |
| 9,808,519 B2 | 11/2017 | Honda et al. | |
| 9,839,655 B2 | 12/2017 | Mulder et al. | |
| 9,855,302 B2 | 1/2018 | Gajewski et al. | |
| 9,937,211 B2 * | 4/2018 | Kelly ..................... A61P 17/06 |
| 9,974,815 B2 | 5/2018 | Mulder et al. | |
| 9,987,311 B2 | 6/2018 | Mulder et al. | |
| 10,046,015 B2 | 8/2018 | Mulder et al. | |
| 10,058,574 B2 | 8/2018 | Grant et al. | |
| 10,080,772 B2 | 9/2018 | Crouzet et al. | |

(Continued)

FOREIGN PATENT DOCUMENTS

CA    2768301 A1    1/2011
CN    1863540 A    11/2006

(Continued)

OTHER PUBLICATIONS

International Search Report dated Aug. 27, 2018 for International Application Serial No. PCT/EP2018/065808, (6 pages).
International Preliminary Report on Patentability dated Oct. 10, 2019 for International Application Serial No. PCT/EP2018/065808, (26 pages).
Keshavarzian, Ali et al., "Colonic bacterial composition in Parkinson's disease": Movement Disorders Sep. 2015;30(10):1351-60. doi: 10.1002/mds.26307. Epub Jul. 16, 2015.
Yin, Jia et al. "Dysbiosis of Gut Microbiota With Reduced Trimethylamine-N-Oxide Level in Patients With Large-Artery Atherosclerotic Stroke or Transient Ischemic Attack." Journal of the American Heart Association vol. 4,11 e002699. Nov. 23, 2015, doi:10.1161/JAHA.115.002699.
Jan. 17, 2019 Notice of Allowance for U.S. Appl. No. 15/803,721.
Dec. 21, 2018 Notice of Allowance U.S. Appl. No. 15/700,700.
Jan. 30, 2019 Notice of Corrected Allowability for U.S. Appl. No. 15/803,721.

(Continued)

*Primary Examiner* — Louise W Humphrey
*Assistant Examiner* — Anjali Ajit Hirani
(74) *Attorney, Agent, or Firm* — Wilson Sonsini Goodrich & Rosati

(57) ABSTRACT

The invention provides compositions comprising bacterial strains for treating and preventing a neurodegenerative disorder.

12 Claims, 9 Drawing Sheets

Specification includes a Sequence Listing.

(56) References Cited

U.S. PATENT DOCUMENTS

| | | |
|---|---|---|
| 10,086,020 B2 | 10/2018 | Bernalier-Donadille et al. |
| 10,086,021 B2 | 10/2018 | Jeffery et al. |
| 10,086,022 B2 | 10/2018 | Bernalier-Donadille et al. |
| 10,086,023 B2 | 10/2018 | Bernalier-Donadille et al. |
| 10,183,046 B2 | 1/2019 | Kelly |
| 10,226,489 B2 | 3/2019 | Patterson et al. |
| 2003/0147858 A1 | 8/2003 | Renaud et al. |
| 2004/0005304 A1 | 1/2004 | Brudnak |
| 2004/0106564 A1 | 6/2004 | Nilius et al. |
| 2006/0062774 A1 | 3/2006 | Davis et al. |
| 2006/0073161 A1 | 4/2006 | Breton |
| 2006/0115465 A1 | 6/2006 | Macfarlane |
| 2007/0167423 A1 | 7/2007 | Bergauer et al. |
| 2007/0258953 A1 | 11/2007 | Duncan et al. |
| 2007/0286913 A1 | 12/2007 | Swain et al. |
| 2008/0069861 A1 | 3/2008 | Brown et al. |
| 2008/0206212 A1 | 8/2008 | McMahon et al. |
| 2008/0260906 A1 | 10/2008 | Stojanovic |
| 2008/0299098 A1 | 12/2008 | Se et al. |
| 2009/0217401 A1 | 8/2009 | Korman et al. |
| 2010/0028449 A1 | 2/2010 | Prakash et al. |
| 2010/0047209 A1 | 2/2010 | Stanton et al. |
| 2010/0247489 A1 | 9/2010 | Saur-Brosch |
| 2010/0284973 A1 | 11/2010 | Schiffer-Mannioui et al. |
| 2010/0303782 A1 | 12/2010 | Cobb et al. |
| 2010/0311686 A1 | 12/2010 | Kasper et al. |
| 2010/0316617 A1 | 12/2010 | Renaud et al. |
| 2011/0053829 A1 | 3/2011 | Baumhof et al. |
| 2011/0086011 A1 | 4/2011 | Kasper et al. |
| 2011/0280840 A1 | 11/2011 | Blaser et al. |
| 2012/0020943 A1 | 1/2012 | Lin |
| 2012/0107279 A1 | 5/2012 | Arigoni et al. |
| 2013/0022575 A1 | 1/2013 | Cassity |
| 2013/0130988 A1 | 5/2013 | Blareau et al. |
| 2013/0195802 A1 | 8/2013 | Moore |
| 2013/0280724 A1 | 10/2013 | Ramadan et al. |
| 2013/0316032 A1 | 11/2013 | Itoh et al. |
| 2013/0336931 A1 | 12/2013 | Wadstroem et al. |
| 2014/0037716 A1 | 2/2014 | Nowill et al. |
| 2014/0056852 A1 | 2/2014 | Guglielmetti et al. |
| 2014/0112897 A1 | 4/2014 | Pyne et al. |
| 2014/0147425 A1 | 5/2014 | Henn et al. |
| 2014/0154218 A1 | 6/2014 | Kohno et al. |
| 2014/0179770 A1 | 6/2014 | Zhang et al. |
| 2014/0193464 A1 | 7/2014 | Lin et al. |
| 2014/0199281 A1 | 7/2014 | Henn et al. |
| 2014/0227227 A1 | 8/2014 | Qin et al. |
| 2014/0328803 A1 | 11/2014 | McKenzie et al. |
| 2014/0335131 A1 | 11/2014 | Mazmanian et al. |
| 2014/0341921 A1 | 11/2014 | Honda et al. |
| 2014/0363397 A1 | 12/2014 | Allen-Vercoe et al. |
| 2015/0044173 A1 | 2/2015 | Jones et al. |
| 2015/0071957 A1 | 3/2015 | Kelly et al. |
| 2015/0104418 A1 | 4/2015 | Flint et al. |
| 2015/0132264 A1 | 5/2015 | Kelly et al. |
| 2015/0284781 A1 | 10/2015 | Klumpp et al. |
| 2016/0058804 A1 | 3/2016 | Jones et al. |
| 2016/0067188 A1 | 3/2016 | Cade et al. |
| 2016/0143961 A1 | 5/2016 | Berry et al. |
| 2016/0184370 A1 | 6/2016 | McKenzie et al. |
| 2016/0199424 A1 | 7/2016 | Berry et al. |
| 2016/0223553 A1 | 8/2016 | Sears et al. |
| 2016/0235792 A1 | 8/2016 | Berry et al. |
| 2017/0143772 A1 | 5/2017 | Mulder et al. |
| 2017/0143773 A1 | 5/2017 | Mulder et al. |
| 2017/0143774 A1 | 5/2017 | Mulder et al. |
| 2017/0143775 A1 | 5/2017 | Mulder et al. |
| 2017/0319634 A1 | 11/2017 | Grant et al. |
| 2017/0326202 A1 | 11/2017 | Kelly |
| 2017/0354695 A1 | 12/2017 | Grant et al. |
| 2017/0360856 A1 | 12/2017 | Grant et al. |
| 2017/0368110 A1 | 12/2017 | Grant et al. |
| 2018/0072778 A1 | 3/2018 | Kelly et al. |
| 2018/0078585 A1 | 3/2018 | Mulder et al. |
| 2018/0078587 A1 | 3/2018 | Crott et al. |
| 2018/0133265 A1 | 5/2018 | Stevenson |
| 2018/0207207 A1 | 7/2018 | Bernalier-Donadille et al. |
| 2018/0207208 A1 | 7/2018 | Jeffery et al. |
| 2018/0214496 A1 | 8/2018 | Bernalier-Donadille |
| 2018/0221421 A1 | 8/2018 | Bernalier-Donadille |
| 2018/0250346 A1 | 9/2018 | Mulder et al. |
| 2018/0271918 A1 | 9/2018 | Kelly et al. |
| 2018/0344780 A1 | 12/2018 | Grant et al. |
| 2018/0369292 A1 | 12/2018 | Bernalier-Donadille et al. |
| 2018/0369293 A1 | 12/2018 | Ian et al. |
| 2019/0000892 A1 | 1/2019 | Mulder et al. |
| 2019/0008908 A1 | 1/2019 | Laureen et al. |
| 2019/0015459 A1 | 1/2019 | George et al. |
| 2019/0099458 A1 | 4/2019 | Grant et al. |
| 2019/0134108 A1 | 5/2019 | Patterson et al. |
| 2019/0134109 A1 | 5/2019 | Mulder et al. |
| 2019/0151380 A1 | 5/2019 | Grant et al. |
| 2019/0175666 A1 | 6/2019 | Mulder et al. |
| 2019/0247448 A1 | 8/2019 | Grant et al. |
| 2019/0255123 A1 | 8/2019 | Jeffery et al. |

FOREIGN PATENT DOCUMENTS

| | | |
|---|---|---|
| CN | 1917946 A | 2/2007 |
| CN | 1954066 A | 4/2007 |
| CN | 101590081 A | 12/2009 |
| CN | 102304483 A | 1/2012 |
| CN | 102031235 B | 7/2012 |
| CN | 102093967 B | 1/2013 |
| CN | 102905558 A | 1/2013 |
| CN | 102940652 A | 2/2013 |
| CN | 102373172 B | 3/2013 |
| CN | 103037876 A | 4/2013 |
| CN | 103142656 A | 6/2013 |
| CN | 103146620 A | 6/2013 |
| CN | 103156888 A | 6/2013 |
| CN | 103652322 A | 3/2014 |
| CN | 103781487 A | 5/2014 |
| CN | 103820363 A | 5/2014 |
| CN | 103849590 A | 6/2014 |
| CN | 103865846 A | 6/2014 |
| CN | 103930117 A | 7/2014 |
| CN | 103981115 A | 8/2014 |
| CN | 103981117 A | 8/2014 |
| CN | 104160014 A | 11/2014 |
| CN | 104195075 A | 12/2014 |
| CN | 103509741 B | 2/2015 |
| CN | 102940652 B | 3/2015 |
| CN | 104435000 A | 3/2015 |
| CN | 103037876 B | 4/2015 |
| CN | 104546932 A | 4/2015 |
| CN | 104546933 A | 4/2015 |
| CN | 104546934 A | 4/2015 |
| CN | 104546935 A | 4/2015 |
| CN | 104546940 A | 4/2015 |
| CN | 104546942 A | 4/2015 |
| CN | 104560820 A | 4/2015 |
| CN | 105112333 A | 12/2015 |
| CN | 103820363 B | 2/2016 |
| CN | 103865846 B | 3/2016 |
| CN | 105982919 A | 10/2016 |
| DE | 19826928 A1 | 12/1999 |
| DE | 10206995 A1 | 9/2003 |
| EP | 0120516 A2 | 10/1984 |
| EP | 0238023 A2 | 9/1987 |
| EP | 0433299 A1 | 6/1991 |
| EP | 0449375 A2 | 10/1991 |
| EP | 0581171 A1 | 2/1994 |
| EP | 0778778 A1 | 6/1997 |
| EP | 0888118 A1 | 1/1999 |
| EP | 1141235 A2 | 10/2001 |
| EP | 1227152 A1 | 7/2002 |
| EP | 1383514 A1 | 1/2004 |
| EP | 1448995 A1 | 8/2004 |
| EP | 1481681 A1 | 12/2004 |
| EP | 1765391 A1 | 3/2007 |
| EP | 1675481 B1 | 11/2008 |
| EP | 1997499 A1 | 12/2008 |
| EP | 1997905 A1 | 12/2008 |

(56) References Cited

FOREIGN PATENT DOCUMENTS

| | | |
|---|---|---|
| EP | 1997906 A1 | 12/2008 |
| EP | 1997907 A1 | 12/2008 |
| EP | 2044436 A2 | 4/2009 |
| EP | 2103226 A1 | 9/2009 |
| EP | 2133088 A3 | 1/2010 |
| EP | 1280541 B2 | 3/2010 |
| EP | 2236598 A1 | 10/2010 |
| EP | 2286832 A1 | 2/2011 |
| EP | 2308498 A1 | 4/2011 |
| EP | 2217253 B1 | 6/2011 |
| EP | 1940243 B1 | 8/2011 |
| EP | 2359838 A1 | 8/2011 |
| EP | 1855550 B1 | 10/2011 |
| EP | 1871400 B1 | 10/2011 |
| EP | 2124972 B1 | 6/2012 |
| EP | 1773361 B2 | 9/2012 |
| EP | 1945234 B1 | 12/2012 |
| EP | 2323493 B8 | 12/2012 |
| EP | 2323494 B8 | 12/2012 |
| EP | 1629850 B2 | 5/2013 |
| EP | 2203551 B1 | 8/2013 |
| EP | 2140771 B1 | 12/2013 |
| EP | 2687227 A1 | 1/2014 |
| EP | 2179028 B1 | 8/2014 |
| EP | 2650002 A4 | 8/2014 |
| EP | 2164349 B1 | 9/2014 |
| EP | 2134835 B1 | 10/2014 |
| EP | 2810652 A2 | 12/2014 |
| EP | 2305838 B1 | 1/2015 |
| EP | 2832859 A1 | 2/2015 |
| ES | 2408279 A2 | 6/2013 |
| JP | H08259450 A | 10/1996 |
| JP | 2003261453 A | 9/2003 |
| JP | 2005097280 A | 4/2005 |
| JP | 2006265212 A | 10/2006 |
| JP | 2007084533 A | 4/2007 |
| JP | 2007116991 A | 5/2007 |
| JP | 2008195635 A | 8/2008 |
| JP | 2009507023 A | 2/2009 |
| JP | 2010246523 A | 11/2010 |
| JP | 5031249 B2 | 9/2012 |
| JP | 2013005759 A | 1/2013 |
| JP | 5183848 B2 | 4/2013 |
| JP | 2013527240 A | 6/2013 |
| JP | 2013201912 A | 10/2013 |
| JP | 2014196260 A | 10/2014 |
| JP | 2014534957 A | 12/2014 |
| JP | 2015500792 A | 1/2015 |
| JP | 5710876 B2 | 4/2015 |
| JP | 5792105 B2 | 10/2015 |
| KR | 100468522 B1 | 1/2005 |
| KR | 20100128168 A | 12/2010 |
| KR | 1020100128168 | 12/2010 |
| KR | 101017448 B1 | 2/2011 |
| KR | 101057357 B1 | 8/2011 |
| KR | 20130021764 A | 3/2013 |
| KR | 101250463 B1 | 4/2013 |
| KR | 20140037544 A | 3/2014 |
| KR | 20140061328 A | 5/2014 |
| PL | 229020 B1 | 5/2018 |
| RU | 2078815 C1 | 5/1997 |
| TW | I417054 B | 12/2013 |
| WO | WO-8807865 A1 | 10/1988 |
| WO | WO-9117243 A1 | 11/1991 |
| WO | WO-9611014 A1 | 4/1996 |
| WO | WO-9720577 A1 | 6/1997 |
| WO | WO-9730717 A1 | 8/1997 |
| WO | WO-9735956 A1 | 10/1997 |
| WO | WO-9843081 A1 | 10/1998 |
| WO | WO-9855131 A1 | 12/1998 |
| WO | WO-9857631 A1 | 12/1998 |
| WO | WO-9919459 A1 | 4/1999 |
| WO | WO-9942568 A1 | 8/1999 |
| WO | WO-9945955 A1 | 9/1999 |
| WO | WO-0116120 A1 | 3/2001 |
| WO | WO-0158275 A2 | 8/2001 |
| WO | WO-0185187 A1 | 11/2001 |
| WO | WO-0193904 A1 | 12/2001 |
| WO | WO-0207741 A1 | 1/2002 |
| WO | WO-0242328 A2 | 5/2002 |
| WO | WO-02070670 A1 | 9/2002 |
| WO | WO-02085933 A1 | 10/2002 |
| WO | WO-02094296 A1 | 11/2002 |
| WO | WO-03010297 A1 | 2/2003 |
| WO | WO-03022255 A2 | 3/2003 |
| WO | WO-03045317 A2 | 6/2003 |
| WO | WO-03046580 A1 | 6/2003 |
| WO | WO-03053220 A2 | 7/2003 |
| WO | WO-2004003235 A3 | 6/2004 |
| WO | WO-2004085628 A1 | 10/2004 |
| WO | WO-2005007834 A1 | 1/2005 |
| WO | WO-2005030133 A2 | 4/2005 |
| WO | WO-2005032567 A2 | 4/2005 |
| WO | WO-2005058335 A1 | 6/2005 |
| WO | WO-2005032567 A3 | 7/2005 |
| WO | WO-2005093049 A1 | 10/2005 |
| WO | WO-2005107381 A2 | 11/2005 |
| WO | WO-2005121130 A2 | 12/2005 |
| WO | WO-2006012586 A2 | 2/2006 |
| WO | WO-2006033949 A1 | 3/2006 |
| WO | WO-2006033950 A1 | 3/2006 |
| WO | WO-2006033951 A1 | 3/2006 |
| WO | WO-2006102350 A1 | 9/2006 |
| WO | WO-2006102536 A2 | 9/2006 |
| WO | WO-2006091103 A3 | 10/2006 |
| WO | WO-2006110406 A2 | 10/2006 |
| WO | WO-2006130205 A1 | 12/2006 |
| WO | WO-2007027761 A2 | 3/2007 |
| WO | WO-2007056218 A2 | 5/2007 |
| WO | WO-2007064732 A1 | 6/2007 |
| WO | WO-2007064749 A1 | 6/2007 |
| WO | WO-2007098371 A2 | 8/2007 |
| WO | WO-2007136719 A2 | 11/2007 |
| WO | WO-2007140230 A3 | 2/2008 |
| WO | WO-2008031438 A3 | 5/2008 |
| WO | WO-2008055702 A1 | 5/2008 |
| WO | WO-2008055703 A2 | 5/2008 |
| WO | WO-2008064489 A1 | 6/2008 |
| WO | WO-2008073148 A2 | 6/2008 |
| WO | WO-2008076696 A2 | 6/2008 |
| WO | WO-2008053444 A3 | 7/2008 |
| WO | WO-2008083157 A2 | 7/2008 |
| WO | WO-2008134450 A2 | 11/2008 |
| WO | WO-2008153377 A1 | 12/2008 |
| WO | WO-2009027753 A1 | 3/2009 |
| WO | WO-2009030481 A1 | 3/2009 |
| WO | WO-2009055362 A1 | 4/2009 |
| WO | WO-2009059284 A1 | 5/2009 |
| WO | WO-2009072889 A1 | 6/2009 |
| WO | WO-2009079564 A2 | 6/2009 |
| WO | WO-2009043856 A3 | 7/2009 |
| WO | WO-2009080862 A1 | 7/2009 |
| WO | WO-2009100331 A2 | 8/2009 |
| WO | WO-2009116864 A1 | 9/2009 |
| WO | WO-2009128949 A2 | 10/2009 |
| WO | WO-2009138220 A1 | 11/2009 |
| WO | WO-2009149149 A1 | 12/2009 |
| WO | WO-2009151315 A1 | 12/2009 |
| WO | WO-2009154463 A2 | 12/2009 |
| WO | WO-2009156301 A1 | 12/2009 |
| WO | WO-2010002241 A1 | 1/2010 |
| WO | WO-2010036876 A1 | 4/2010 |
| WO | WO-2010037402 A1 | 4/2010 |
| WO | WO-2010037408 A1 | 4/2010 |
| WO | WO-2010037539 A1 | 4/2010 |
| WO | WO-2010048481 A1 | 4/2010 |
| WO | WO-2010063601 A1 | 6/2010 |
| WO | WO-2010081126 A3 | 9/2010 |
| WO | WO-2010129839 A1 | 11/2010 |
| WO | WO-2010130659 A1 | 11/2010 |
| WO | WO-2010130660 A1 | 11/2010 |
| WO | WO-2010130662 A1 | 11/2010 |
| WO | WO-2010130663 A1 | 11/2010 |
| WO | WO-2010130697 A1 | 11/2010 |

(56) References Cited

FOREIGN PATENT DOCUMENTS

| | | |
|---|---|---|
| WO | WO-2010130699 A1 | 11/2010 |
| WO | WO-2010130700 A1 | 11/2010 |
| WO | WO-2010130701 A1 | 11/2010 |
| WO | WO-2010130702 A1 | 11/2010 |
| WO | WO-2010130704 A1 | 11/2010 |
| WO | WO-2010130710 A1 | 11/2010 |
| WO | WO-2010130713 A1 | 11/2010 |
| WO | WO-2010/143940 | 12/2010 |
| WO | WO-2010139531 A1 | 12/2010 |
| WO | WO-2010142504 A1 | 12/2010 |
| WO | WO-2010143961 A1 | 12/2010 |
| WO | WO-2010147714 A1 | 12/2010 |
| WO | WO-2010133475 A3 | 1/2011 |
| WO | WO-2011000620 A1 | 1/2011 |
| WO | WO-2011000621 A1 | 1/2011 |
| WO | WO-2011005756 A1 | 1/2011 |
| WO | WO-2010133472 A3 | 2/2011 |
| WO | WO-2011020748 A1 | 2/2011 |
| WO | WO-2011036539 A1 | 3/2011 |
| WO | WO-2011043654 A1 | 4/2011 |
| WO | WO-2011044208 A1 | 4/2011 |
| WO | WO-2011058535 A1 | 5/2011 |
| WO | WO-2011075138 A1 | 6/2011 |
| WO | WO-2011096808 A1 | 8/2011 |
| WO | WO-2011096809 A1 | 8/2011 |
| WO | WO-2011110918 A1 | 9/2011 |
| WO | WO-2011121379 A1 | 10/2011 |
| WO | WO-2011149335 A1 | 12/2011 |
| WO | WO-2011152566 A2 | 12/2011 |
| WO | WO-2011153226 A2 | 12/2011 |
| WO | WO-2011157816 A1 | 12/2011 |
| WO | WO-2012012874 A1 | 2/2012 |
| WO | WO-2012016287 A2 | 2/2012 |
| WO | WO-2012024638 A2 | 2/2012 |
| WO | WO-2011153226 A3 | 3/2012 |
| WO | WO-2012055408 A1 | 5/2012 |
| WO | WO-2012062780 A1 | 5/2012 |
| WO | WO-2012071380 A1 | 5/2012 |
| WO | WO-2012076739 A1 | 6/2012 |
| WO | WO-2012105312 A1 | 8/2012 |
| WO | WO-2012122478 A1 | 9/2012 |
| WO | WO-2012140636 A1 | 10/2012 |
| WO | WO-2012142605 A1 | 10/2012 |
| WO | WO-2012145491 A2 | 10/2012 |
| WO | WO-2012158517 A1 | 11/2012 |
| WO | WO-2012165843 A2 | 12/2012 |
| WO | WO-2012170478 A2 | 12/2012 |
| WO | WO-2013005836 A1 | 1/2013 |
| WO | WO-2013008039 A2 | 1/2013 |
| WO | WO-2013008102 A2 | 1/2013 |
| WO | WO-2013037068 A1 | 3/2013 |
| WO | WO-2013050792 A1 | 4/2013 |
| WO | WO-2013053836 A1 | 4/2013 |
| WO | WO-2013063849 A1 | 5/2013 |
| WO | WO-2013080561 A1 | 6/2013 |
| WO | WO-2013124725 A1 | 8/2013 |
| WO | WO-2013144701 A1 | 10/2013 |
| WO | WO-2013153358 A1 | 10/2013 |
| WO | WO-2013154725 A1 | 10/2013 |
| WO | WO-2013171515 A1 | 11/2013 |
| WO | WO-2013175038 A1 | 11/2013 |
| WO | WO-2013181694 A1 | 12/2013 |
| WO | WO-2013182038 A1 | 12/2013 |
| WO | WO-2014001368 A1 | 1/2014 |
| WO | WO-2014019271 A1 | 2/2014 |
| WO | WO-2014020004 A1 | 2/2014 |
| WO | WO-2014032108 A1 | 3/2014 |
| WO | WO-2014036182 A2 | 3/2014 |
| WO | WO-2014043593 A2 | 3/2014 |
| WO | WO-2014053608 A1 | 4/2014 |
| WO | WO-2014064359 A1 | 5/2014 |
| WO | WO-2014067976 A1 | 5/2014 |
| WO | WO-2014070014 A1 | 5/2014 |
| WO | WO-2014070225 A1 | 5/2014 |
| WO | WO-2014075745 A1 | 5/2014 |
| WO | WO-2014078911 A1 | 5/2014 |
| WO | WO-2014082050 A1 | 5/2014 |
| WO | WO-2014093622 A2 | 6/2014 |
| WO | WO-2014093635 A1 | 6/2014 |
| WO | WO-2014093655 A2 | 6/2014 |
| WO | WO-2014121298 A2 | 8/2014 |
| WO | WO-2014121301 A1 | 8/2014 |
| WO | WO-2014121302 A2 | 8/2014 |
| WO | WO-2014121304 A1 | 8/2014 |
| WO | WO-2014130540 A1 | 8/2014 |
| WO | WO-2014137211 A1 | 9/2014 |
| WO | WO-2014145958 A2 | 9/2014 |
| WO | WO-2014150094 A1 | 9/2014 |
| WO | WO-2014152338 A1 | 9/2014 |
| WO | WO-2014153194 A2 | 9/2014 |
| WO | WO-2014121302 A3 | 10/2014 |
| WO | WO-2014167338 A1 | 10/2014 |
| WO | WO-2014182966 A1 | 11/2014 |
| WO | WO-2014200334 A1 | 12/2014 |
| WO | WO-2014201037 A2 | 12/2014 |
| WO | WO-2015003001 A1 | 1/2015 |
| WO | WO-2015006355 A2 | 1/2015 |
| WO | WO-2015013214 A2 | 1/2015 |
| WO | WO-2015017625 A1 | 2/2015 |
| WO | WO-2015021936 A1 | 2/2015 |
| WO | WO-2015033305 A1 | 3/2015 |
| WO | WO-2015038731 A1 | 3/2015 |
| WO | WO-2015057151 A1 | 4/2015 |
| WO | WO-2015077794 A1 | 5/2015 |
| WO | WO-2015095241 A2 | 6/2015 |
| WO | WO-2015077794 A4 | 7/2015 |
| WO | WO-2015156419 A1 | 10/2015 |
| WO | WO-2015156519 A1 | 10/2015 |
| WO | WO-2015168534 A1 | 11/2015 |
| WO | WO-2015169944 A1 | 11/2015 |
| WO | WO-2015095241 A4 | 12/2015 |
| WO | WO-2016019505 A1 | 2/2016 |
| WO | WO-2016019506 A1 | 2/2016 |
| WO | WO-2016033439 A2 | 3/2016 |
| WO | WO-2016036615 A1 | 3/2016 |
| WO | WO-2016057671 A1 | 4/2016 |
| WO | WO-2016065324 A1 | 4/2016 |
| WO | WO-2016069795 A2 | 5/2016 |
| WO | WO-2016069801 A1 | 5/2016 |
| WO | WO-2016070151 A1 | 5/2016 |
| WO | WO-2016086161 A1 | 6/2016 |
| WO | WO-2016086205 A2 | 6/2016 |
| WO | WO-2016086206 A1 | 6/2016 |
| WO | WO-2016086208 A1 | 6/2016 |
| WO | WO-2016086209 A1 | 6/2016 |
| WO | WO-2016086210 A1 | 6/2016 |
| WO | WO-2016102950 A1 | 6/2016 |
| WO | WO-2016102951 A1 | 6/2016 |
| WO | WO-2016118730 A1 | 7/2016 |
| WO | WO-2016139217 A1 | 9/2016 |
| WO | WO-2016149449 A1 | 9/2016 |
| WO | WO-2016149687 A1 | 9/2016 |
| WO | WO-2016203218 A1 | 12/2016 |
| WO | WO-2016203220 A1 | 12/2016 |
| WO | WO-2016203221 A1 | 12/2016 |
| WO | WO-2017079450 A1 | 5/2017 |
| WO | WO-2017085520 A1 | 5/2017 |
| WO | WO-2017091753 A1 | 6/2017 |
| WO | WO-2017148596 A1 | 9/2017 |
| WO | WO-2017160711 A1 | 9/2017 |
| WO | WO-2018011594 A1 | 1/2018 |
| WO | WO-2018047106 A1 | 3/2018 |
| WO | WO-2018/112365 A2 | 6/2018 |
| WO | WO-2018112363 | 6/2018 |
| WO | WO-2018112363 A1 | 6/2018 |
| WO | WO-2018112365 A2 | 6/2018 |
| WO | WO-2018215782 A1 | 11/2018 |

(56) References Cited

FOREIGN PATENT DOCUMENTS

| WO | WO-2018229188 A1 | 12/2018 |
| WO | WO-2019010255 A1 | 1/2019 |

OTHER PUBLICATIONS

Jan. 30, 2019 Final Rejection for U.S. Appl. No. 15/842,635.
Feb. 1, 2019 Non-Final Office Action U.S. Appl. No. 16/040,356.
Mar. 4, 2019 Final Office Action for U.S. Appl. No. 15/704,245.
4d Pharma Plc: "Clinical Update—RNS—London Stock Exchange", Jul. 19, 2016.
4D Pharma:"4Dpharma PLC clinical update on blautix (TM), a novel treatment to irritable bowel syndrome," 4DPharma, Jan. 19, 2016, XP002769874, Retrieved from: https://www.directorstalkinterviews.com/4d-pharma-plc-clinical-update-on-blautix-a-novel-treatment-for-irritable-bowel-syndrome/412689588. [Retrieved on May 5, 2017].
Abel and Zukin, "Epigenetic targets of HDAC inhibition in neurodegenerative and psychiatric disorders", 2008, Current Opinion Pharmacology, 2008. 8(1): 57-64.
Ahanchian, Hamic, A multi-strain synbiotic may reduce viral respiratory infections in asthmatic children: a randomized controlled trial; Sep. 2016, vol. 8, Issue 9, pp. 2833-2839, DOI: http://dxdoi.or/10.19082/2833.
Alp, G., and Aslim, B. (2010). Relationship between the resistance to bile salts and low pH with exopolysaccharide (EPS) production of *Bifidobacterium* spp. isolated from infants feces and breast milk. Anaerobe 16(2), 101-105. doi: 10.1016/j.anaerobe.2009.06.006.
Altschul et al. 'Basic local alignment search tool.' Journal of Molecular Biology. 1990, vol. 215, No. 3, pp. 403-410.
"Amedei, A. et al. Multiple sclerosis: the role of cytokines in pathogenesis and in therapies. Int J Mol Sci. Oct. 19, 2012;13(10):13438-60. doi: 10.3390/ijms131013438."
Aminov et al. Molecular diversity, cultivation, and improved detection by fluorescent in situ hybridization of a dominant group of human gut bacteria related to *Roseburia* spp. or Eubacterium rectale. Applied and environmental microbiology. 2006, vol. 72, No. 9, pp. 6371-6376.
Amor, Sandra et al., Inflammation in neurodegenerative diseases—an update, Immunology 2013 142 151.
An et al. (1985) "New cloning vehicles for transformation of higher plants," EMBO J. 4:277-284.
An et al. (1988) "Binary Vectors," Plant Molecular Biology Manual. A3:1-19.
An et al. Transformation of Tobacco, Tomato, Potato, and *Arabiodopsis thaliana* Using a Binary Ti Vector System,Plant Physiol. May 1986; 81:301-305.
Anonymous: "4D pharma's Blautix for Irritable Bowel Syndrome shows positive impact—pharmaceutical daily news", Dec. 13, 2016.
Appleyard, Caroline B. et al., Pretreatment with the probiotic VSL#3 delays transition from inflammation to dysplasia in rate model of colitis-associated cancer; Am J. Physiol. Gastrointest. Liver Physiol. 301:G1004-G1013, 2011, Sep. 8, 2011:DOI:10.1152.ajpg.00167.2011.
Archer et al. (1997) "The Molecular Biology of Secreted Enzyme Production by Fungi," Critical Reviews Biotechnology. 17(4):273-306.
Arenberg, et al., Interferon-y-inducible Protein 10 (IP-10) Is an Angiostatic Factor That Inhibits Human Non-small Cell Lung Cancer (NSCLC) Tumorigenesis and Spontaneous Metastases. 1996. J. Exp.Med. 184:981-92.
Atarashi et al. Induction of colonic regulatory T cells by indigenous *Clostridium* species. Science 331(6015):337-341 (2011).
Atarashi et al., Th17 Cell Induction by Adhesion of Microbes to Intestinal Epithelial Cells. Cell, vol. 163, No. 2, Oct. 8, 2015. pp. 367-380.
Atarashi, et al., Treg induction by a rationally selected mixture of Clostridia strains from the human microbiota. Supplementary Information. Nature 500, 232-236 (Aug. 8, 2013) doi:10.1038/nature12331.
Atarashi, K. et al., Treg induction by a rationally selected mixture of Clostridia strains from the human microbiota. Nature. 2013; 500(7461):232-236.
ATCC Catalog, https://www.atcc.org/search_results.aspx?dsNav=Ntk:primarysearch%7cbacteroides+thetaiotaomicron%7c3%7c,Ny:true,ro:0,N:1000552&searchterms=bacteroides+thetaiotaomicron&redir=1, Accessed on May 2, 2018.
Auriel, E. et al., "Chapter 38—Nonsteroidal anti-inflammatory drugs exposure and the central nerous system", 2014, Handbook of Clinical Neurology 119, 577-584.
Ausubel et al. (1999) Short Protocols in Molecular Biology. 4th edition, pp. 7-58 to 7-60, and Chapter 18. pp. 18-1 to 18-23.
Awadel-Kariem, Mustafa et al., First report of Parabacteroides goldsteinii bacteraemia in a patient with complicated intra-abdominal infection, Anaerobe, vol. 16, Issue 3, Jun. 2010, pp. 223-225.
Azad, M.B. et al., Probiotic supplementation during pregnancy or infancy for the prevention of asthma and wheeze: systematic review and meta-analysis BMJ 2013; 347 :f6471.
Aziz et al. The RAST Server: rapid annotations using subsystems technology. BMC Genomics. 2008, vol. 9, No. 1, pp. 75.
Aziz, R.K., Bartels, D., Best, A.A., DeJongh, M., Disz, T., Edwards, R.A., et al. (2008). The RAST Server: Rapid Annotations using Subsystems Technology. BMC Genomics 9, 75. doi: 10.1186/1471-2164-9-75.
Bagge, et al., Diversity of spore-forming bacteria in cattle manure, slaughterhouse waste and samples from biogas plants. Journal of applied microbiology. 2010;109: 1549-1565.
Balato, et al., Effects of adalimumab therapy in adult subjects with moderate-to-severe psoriasis on Th17 pathway. (2014) J Eur Acad Dermatol Venereol. 28(8):1016-24.
Banfield, J. & Murphy, K.R., Non-Th2, Late-onset, non-allergic asthma. Copd & Asthma for NPs, A peer-reviewed newsletter, Aug. 2016; 14: 8 Pages.
Bansal,Tarun et al., The bacterial signal indole increases epithelial-cell tight-junction resistance and attenuates indicators of inflammation, PNAS 2010, 107, 228.
Barcenilla, et al. Phylogenetic relationships of butyrate-producing bacteria from the human gut. Appl Environ Microbiol. Apr. 2000. 66(4):1654-61.
Barry, et al., Criteria for Disksusceptibility tests and quality control guidelines for the cefoperazone-sulbactam combination, Journal of clinical microbiology, Jan. 1988;26(1):13-17.
Beaucage, et al. Deoxynucleoside phosphoramidites—A new class of key intermediates for deoxypolynucleotide synthesis. Tetrahedron Letters, vol. 22, 1981, pp. 1859-1869.
Beggs (1978) "Transformation of yeast by a replicating hybrid plasmid," Nature. 275:104-109.
Begley, M., Hill, C., and Gahan, C.G.M. (2006). Bile Salt Hydrolase Activity in Probiotics. Applied and Environmental Microbiology 72(3), 1729-1738. doi: 10.1128/AEM.72.3.1729-1738.2006.
Berg et al. (1996) "Enterocolitis and colon cancer in interleukin-10-deficient mice are associated with aberrant cytokine production and CD4(+) TH1-like responses," The Journal of Clinical Investigation. 98(4):1010-1020.
Berger, B., Moine, D., Mansourian, R., and Arigoni, F. (2010). HspR Mutations Are Naturally Selected in Bifidobacterium longum When Successive Heat Shock Treatments Are Applied. Journal of Bacteriology 192(1), 256-263. doi: 10.1128/jb.01147-09.
Berger, S. Gideon guide to medically important bacteria. Gideon E-book Series. 2017 edition. 4 pages.
Bergonzelli, G.E., Granato, D., Pridmore, R.D., Marvin-Guy, L.F., Donnicola, D., and Corthesy-Theulaz, I.E. (2006). GroEL of Lactobacillus johnsonii La1 (NCC 533) is cell surface associated: potential role in interactions with the host and the gastric pathogen Helicobacter pylori. Infect Immun 74(1), 425-434. doi: 10.1128/IAI.74.1.425-434.2006.
Bernalier, A., et al., "Diversity of H2/C02-utilizing acetogenic Bacteria from Feces of Non-Methane-Producing Humans", Current Microbiology vol. 33 (Aug. 1996), pp. 94-99, Springer-Vertag New York Inc., USA.

(56) References Cited

OTHER PUBLICATIONS

Bernalier et al., "Acetogenesis from H02 and C0-2 By Methane and Non-Methane-Producing Human Colonic Bacterial Communities" Fems Microbiology Ecology, vol. 19. No. 3. 1996. pp. 193-202. XP000979130.

Bernalier et al. *Ruminococcus hydrogenotrophicus* sp. nov., a new H2/CO2-utilizing acetogenic bacterium isolated from human feces. 1996 Arch. Microbiol. 166 (3), 176-183.

Bertram, J. et al. Establishment of a cloned line of Lewis lung carcinoma cells adapted to cell culture. (1980) Cancer let. 11:63-73.

Björkqvist ,Maria et al., A novel pathogenic pathway of immune activation detectable before clinical onset in Huntington's disease, J Exp Med (2008) 205 (8): 1869-1877.

Blandino, G., Fazio, D., DiMarco, R. Probiotics: Overview of microbiological and immunological characteristics (2008). Expert Review of Anti-Infective Therapy, 6 (4), pp. 497-508.

Bond, John H., Jr., et al., "Factors Influencing Pulmonary Medicine Excretion in Man: An indirect method of studying the in situ metabolism of the methane-producing colonic bacteria"; Journal of Experimental Medicine, Oct. 29, 1970, pp. 572-388.

Born, P., et al., English Abstract "Carbohydrate substitutes: comparative study of intestinal absorption of fructose, sorbitol and xylitol", "Zuckeraustauschstoffe: Vergleichende Untersuchung zur intestinalen Resorption von Fructose, Sorbit und Xylit", Medizinische Klinik 89, Technischen Universitat Munchen (Munich) Nov. 15, 1994; 89 (11): 575-8 (Article in German), Urban & Vogel, Munich, Germany.

Born, P., et al., "Fecal bacterial activity in symptomatic carbohydrate malabsorption: Effect on the fecal short-chain fatty acid ratio", intervention during the week "Digestive Diseases Week" from May 16 to May 19, 1999, Orlando, Z. Gasteroenterol2000: 38:623-626, Georg Thieme Verlag Stuttgart, New York, USA.

Bottacini, et al., Comparative genomics of the Bifidobacterium brevetaxon. BMC Genomics, 2014; 15:170. DOI:10.1186/1471-1471-2164-15-170.

Bottacini, F., Morrissey, R., Esteban-Torres, M., James, K., van Breen, J., Dikareva, E., et al. (2018). Comparative genomics and genotype-phenotype associations in Bifidobacterium breve. Scientific Reports 8(1), 10633. doi: 10.1038/s41598-018-28919-4.

Bottacini, F., O'Connell Motherway, M., Kuczynski, J., O'Connell, K.J., Serafini, F., Duranti, S., et al. (2014). Comparative genomics of the Bifidobacterium breve taxon. BMC Genomics 15(1), 170. doi: 10.1186/1471-2164-15-170.

Brand et al., Collagen-induced arthritis, 2007; Protocol 2(5):1269-1275.

Brasel et al. (2000) "Generation of murine dendritic cells from ftl3-ligand-supplemented bone marrow cultures," Blood. 96(9):3029-3039.

Bressa, et al., Differences in gut microbiota profile between women with active lifestyle and sedentary women. Plos One, 2017; 12(2): 1-20.

Brook, I., Clinical Review: Bacteremia caused by anaerobic bacteria in children. Critical Care 6(3): 7 pages (2002).

Brosseron, Frederic, Body Fluid Cytokine Levels in Mild Cognitive Impairment and Alzheimer's Disease: a comparative overview, Mol Neurobiol (2014) 50:534.

Bry et al. A model of host-microbial interactions in an open mammalian ecosystem. Science 273(5280):1380-1383 (1996).

Buffie et al., Precision microbiome restoration of bile acid-mediated resistance to Clostridium difficile. Nature, 517(7533):205-208 (2015).

Busing, K. et al., Effects of oral Enterococcus faecium strain DSM 10663 NCIMB 10415 on diarrhoea patterns and performance of sucking piglets. Benef Microbes. Mar. 2015;6(1):41-4. doi: 10.3920/BM2014.0008.

Butcher et al. (1980) The role of tissue culture in the study of crown-gall tumorigenesis. Tissue Culture Methods for Plant Pathologists. Eds.: Ingrams, D. S.; Helgeson, J.P. pp. 203-208.

Campbell, I L et al. "Neurologic disease induced in transgenic mice by cerebral overexpression of interleukin 6." Proceedings of the National Academy of Sciences of the United States of America vol. 90,21 (1993): 10061-5. doi:10.1073/pnas.90.21.10061.

"Campeau, J.L. et al., Intestinal Epithelial Cells Modulate Antigen-Presenting Cell Responses to Bacterial DNA. Infectionand Immunity. Aug. 2012; 80(8): 2632-2644."

Candela et al. 'Interaction of probiotic Lactobacillus and Bifidobacterium strains with human intestinal epithelial cells:Adhesion properties, competition against enteropathogens and modulation of IL-8 production'. International Journal of Food Microbiology. 2008, vol. 125, No. 3, pp. 286-292.

Candela, M., Bergmann, S., Vici, M., Vitali, B., Turroni, S., Eikmanns, B.J., et al. (2007). Binding of human plasminogen to Bifidobacterium. J Bacteriol 189(16), 5929-5936. doi: 10.1128/JB.00159-07.

Candela, M., Biagi, E., Centanni, M., Turroni, S., Vici, M., Musiani, F., et al. (2009). Bifidobacterial enolase, a cell surface receptor for human plasminogen involved in the interaction with the host. Microbiology 155(Pt 10), 3294-3303. doi: 10.1099/mic.0.028795-0.

Candela, M., Centanni M Fau—Fiori, J., Fiori J Fau—Biagi, E., Biagi E Fau—Turroni, S., Turroni S Fau—Orrico, C., Orrico C Fau—Bergmann, S., et al. (2010). DnaK from *Bifidobacterium animalis* subsp. lactis is a surface-exposed human plasminogen receptor upregulated in response to bile salts. Microbiology 156(6), 1609-1618.

Caruthers, et al. New chemical methods for synthesizing polynucleotides. Nucleic Acids Symp Ser. 1980;(7):215-23.

Carvalho et al. (Jan. 2011) "TLR5 activation induces secretory interleukin-1 receptor antagonist (sll-1 Ra) and reduces infammasome-associated tissue damage," Nature. 4(1 ):102-111.

Casey et al. 'Isolation and characterization of anti-*Salmonella* lactic acid bacteria from the porcine gastrointestinal tract'. Letters in Applied Microbiology. 2004, vol. 39, No. 5, pp. 431-438.

Caspi, P.R. Experimental autoimmune uveoretinitis in the rat and mouse. Curr Protoc Immunol. May 2003;Chapter 15:Unit 15.6. doi: 10.1002/0471142735.im1506s53.

Cekanaviciute, et al., Gut bacteria from multiple sclerosis patients modulate human T cells and exacerbate symptoms in mouse models. PNAS. Jun. 30, 2017; 1-6.

Cereghino et al. (2000) "Heterologous protein expression in the methylotrophic yeast *Pichia pastoris*," FEMS Microbiol Review. 24(1 ):45-66.

Charriot, et al., Future treatment for ashtma, Eur Respir Rev 2016; 25: 77-92.

Cheluvappa, R. et al., T helper type 17 pathway suppression by appendicitis and appendectomy protects against colitis. Clin Exp Immunol. Feb. 2014;175(2):316-22. doi: 10.1111/cei.12237.

Chen, S. et al., Live combined bacillus subtilis and enterococcus faecium ameliorate murine experimental colitis by immunosuppression. International journal of inflammation. 2014(878054). 7 Pages.

Chen, Y., Stankovic, R., Cullen, K.M. et al. The Kynurenine Pathway and Inflammation in Amyotrophic Lateral Sclerosis. Neurotox Res 18,132-142 (2010). https://doi.org/10.1007/s12640-009-9129-7.

Chevreux et al. 'Genome sequence assembly using trace signals and additional sequence information.' German Conference on Bioinformatics. 1999.

Chi, W. et al., IL-23 promotes CD4+ T cells to produce IL-17 in Vogt-Koyanagi-Harada disease. J Allergy Clin Immunol. May 2007;119(5):1218-24. Epub Mar. 1, 2007.

Chi, W. et al. Upregulated IL-23 and IL-17 in Behçet patients with active uveitis. Invest Ophthalmol Vis Sci. Jul. 2008;49(7):3058-64. doi: 10.1167/iovs.07-1390.

Chitnis, Tanuja et al., CNS inflammation and neurodegeneration, The Journal of Clinical Investigation, 2017 127 10.

Chiu, et al., Monocolonization of germ-free mice with bacteroides fragilis protects against dectran sulfate sodium-induced acute colitis. Biomed Research International 2014. vol. 2014. Article ID 675786. 9 Pages.

Choji Kaneuchi et al., "Clostridium coccoides, a New Species from the Feces of Mice", International Journal of Systematic Bacteriology, vol. 26, No. 4, Oct. 1976, p. 482-486.

Chothia et al. The relation between the divergence of sequence and structure in proteins. EMBO Journal. 1986, 5(4):823-826.

(56) References Cited

OTHER PUBLICATIONS

Christiaen, S.E., O'Connell Motherway, M., Bottacini, F., Lanigan, N., Casey, P.G., Huys, G., et al. (2014). Autoinducer-2 plays a crucial role in gut colonization and probiotic functionality of Bifidobacterium breve UCC2003. PLoS One 9(5), e98111. doi: 10.1371/journal.pone.0098111.

Christmann, et al., Human seroreactivity to gut microbiota antigens. J Allergy Clin Immunol 136(5):1378-1386; available online May 23, 2015.

Christou (1994) "Genetic engineering of crop legumes and cereals: current status and recent advances," Agro-Food Industry Hi-Tech. pp. 17-27.

Chuang et al., Multiple roles of HDAC inhibition in neurodegenerative conditions, 2009 Trends Neurosci 32(11), 591-601.

Chuang, De-Maw et al., Multiple roles of HDAC inhibition in neurodegenerative conditions, Trends in Neuroscience, vol. 32, Issue 11,Nov. 2009, pp. 591-601.

Chung et al. 'Microbiota-stimulated immune mechanisms to maintain gut homeostasis.' Current Opinion in Immunology. 2010, vol. 22, No. 4, pp. 455-460.

Chyan, et al. 1999, Potent Neuroprotective Properties against the Alzheimer β-Amyloid by an Endogenous Melatonin-related Indole Structure, Indole-3-propionic Acid,The Journal of Biological Chemistry 274(31) 21937-21942.

Cintas LM, Casaus MP, Herranz C, Nes IF, Hernandez PE. Review: bacteriocins of lactic acid bacteria (2001). Food Sci Technol 7(4):281-305.

Claesson, et al. Gut microbiota composition correlates with diet and health in the elderly. 2012. Nature, 488, 178-184.

Clarridge III, J.E. Impact of 16S rRNA gene sequence analysis for identification of bacteria on clinical microbiology and infectious diseases (2004). Clinical Microbiology Reviews, 17 (4), pp. 840-862.

Clinical Trials forThetanix, EU Clinical Trials Register, Date of commencement of clinical trial: Oct. 16, 2015. Available at: https://clinicaltrialsregister.eu/ctr-search/search?query=Thetanix.

Coakley M et al: Intestinal bifidobacteria that produce trans-9, trans-11 conjugated linoleicacid: A fatty acid with antiproliferative activity against human colon SW480and HT-29 cancer cells, Nutrition and Cancer, Taylor & Francis Group, US vol. 56, No. 1, Jan. 1, 2006 (Jan. 1, 2006), pp. 95-102, XP008087265, ISSN: 0163-5581, DOI:10.1207/515327914NC5601 13 cf. abstract, p. 101, last para. of the right-hand col.

Colin, et al., GIC-1001, A Clinical Stage, Orally Administered Colonic Analgesic Drug Proposed as a Cost-Effective Alternative to I.V. Sedation Used in Colonoscopy. Canadian Digestive Diseases Week, 2014; 2 pages.

Collins, M.D., et al., *Enterococcus avium* nom. rev., comb, nov.; *E. casseliflavus* nom. rev., comb, nov.; *E. durans* nom. rev., comb, nov.; *E. gallinarum* comb, nov.; and *E. malodoratus* sp. nov. (1984) Int J Syst Evol Microbiol. 34: 220-223.

Constantinescu et al. Experimental autoimmune encephalomyelitis (EAE) as a model for multiple sclerosis (MS). 2011. Br J Pharmacol. 164(4):1079-1106.

Co-pending U.S. Appl. No. 15/359,144, filed Nov. 22, 2016.
Co-pending U.S. Appl. No. 15/916,205, filed Mar. 8, 2018.
Co-pending U.S. Appl. No. 16/206,250, filed Nov. 30, 2018.

Cotter, P.O., Hill, C., Ross, R.P. Food microbiology: Bacteriocins: Developing imlate immunity for food (2005). Nature Reviews Microbiology, 3 (10), pp. 777-788.

Crellin et al. (2005) "Human CD4+ T cells express TLR5 and its ligand ftagellin enhances the suppressive capacity and expression of FOXP3 in CD4+CD25+ T regulatory cells," Journal of Immunology. 175(12):8051-8059.

Cronin, M., Knobel, M., O'Connell-Motherway, M., Fitzgerald, G.F., and van Sinderen, D. (2007). Molecular Dissection of a Bifidobacterial Replicon. Applied and Environmental Microbiology 73(24), 7858-7866.

Cryan, John F, and Timothy G Dinan. "More than a gut feeling: the microbiota regulates neurodevelopment and behavior." Neuropsychopharmacology : official publication of the American College of Neuropsychopharmacology vol. 40,1 (2015): 241-2. doi:10.1038/npp.2014.224.

Cummings, M., Breitling, R., and Takano, E. (2014). Steps towards the synthetic biology of polyketide biosynthesis. Fems Microbiology Letters 351(2), 116-125. doi: 10.1111/1574-6968.12365.

Dahya V. et al., Clostridium ramosum Osteomyelitis in an immunocompetent patient after traumatic injury, Infectious Diseases in Clinical Practice Mar. 12, 2015 Lippincott Williams and Wilkins USA, vol. 23, No. 2, Mar. 12, 2015, pp. 102-104, XP009193312, ISSN: 1056-9103 the whole document.

Daniel Garrido et al., "Utilization of galactooligosaccharides by *Bifidobacterium longum* subsp. infantis isolates", Food Microbiology, 33 (2013) 262-270.

Daniele, Stefano G et al. "Activation of MyD88-dependent TLR1/2 signaling by misfolded α-synuclein, a protein linked to neurodegenerative disorders." Science signaling vol. 8,376 ra45. May 12, 2015, doi:10.1126/scisignal.2005965.

Darfeuille-Michaud et al. High prevalence of ad he re nt-invasive *Escherichia coli* associated with ileal mucosa in Crohn's disease. .2004. Gastroenterology 127(2):412-21.

Darlington, G.J., Liver Cell Lines. (1987) Meth Enzymol. 151:19-38.

Database UniProt [Online] Jun. 1, 2003 (Jun. 1, 2003), "subname:Full= possible pirin family protein {ECO:0000313|EMBL:AAO75294. 1};", XP00275366,retrieved from EBI accession No. UNIPROT:Q8ABC3 Database accession No. Q8ABC3.

Database WPI, Week 201801, Thomson Scientific, London, GB; AN 2017-834299, XP002787097, & WO 2017/209156 AI (Morinaga Milk Ind Co. Ltd) Dec. 7, 2017 (Dec. 7, 2017) * abstract * of WO2017/2019156, Kobayashi, Youdai et al.

Database WPI,Week 201801, Thomson Scientific, London, GB; AN 2017-834299, XP002787097,& WO 2017/209156 AI (Morinaga Milk Ind Co Ltd) Dec. 7, 2017 (Dec. 7, 2017) * abstract*.

Davis et al. (1971) "Genetic and Microbiological Research Technqiues," Methods Enzymol. 17A:79-143.

Davis et al., Genetic and Microbiological Research Techniques, Methods Enzymol. 1970; 17A:79-143.

De Paepe et al. 'Trade-off between bile resistance and nutritional competence drives *Escherichia coli* diversification in the mouse gut.' PLoS Genetics. 2011, vol. 7, No. 6, e1002107.

De Ruyter, P.G., Kuipers, O.P., and de Vos, W.M. (1996). Controlled gene expression systems for Lactococcus lactis with the food-grade inducer nisin. Applied and Environmental Microbiology 62(10), 3662-3667.

Dean & Elian "Motor neuron disease and multiple sclerosis mortality in Australia, New Zealand and South Africa compared with England and Wales" 1993, J Neurol Neurosurg Psychiatry 56(6) 633-637.

Deangelis, M., et al., Selection of potential probiotic lactobacilli from pig feces to be used as additives in pelleted feeding (2006). Research in Microbiology, 157 (8), pp. 792-801.

Delgado, S., Ruiz, L., Hevia, A., Ruas-Madiedo, P., Margolles, A., and Sánchez, B. (2018). "Evidence of the In Vitro and In Vivo Immunological Relevance of Bifidobacteria," in The Bifidobacteria and Related Organisms.), 295-305.

Demarche, et al., Detailed analysis of sputum and systemic inflammation in asthma phenotypes: are paucigranulocytic asthmatics really non-inflammatory?, BMC Pulmonary Medicine, 2016; (16)46: 1-13.

Dennis et al. 'DAVID: database for annotation, visualization, and integrated discovery.' Genome Bioi. 2003, vol. 4, No. 5, pp. 3.

Desplats, Paula et al., Molecular and pathologic insights from latent HIV-1 infection in the human brain, Neurology, Apr. 9, 2013, 80 (15) 1415-1423.

Dheeraj Mohania et al., "Modulation of expression of Programmed Death-1 by administration of probiotic Dahi in DMH-induced colorectal carcinogenesis in rats", Acta Biomed 2013; 84: 102-109.

Didonna & Opal, The promise and perils of HDAC inhibitors in neurodegeneration,2 015, Ann Clin Transl Neurol, 2(1) 79-101.

Distrutti, et al., 5-Amino-2-hydroxybenzoic Acid 4-(5-Thioxo-5H-[1,2]dithiol-3yl)-phenyl Ester (ATB-429), a Hydrogen Sulfide-Releasing Derivative of Mesalamine, Exerts Antinociceptive Effects

(56) References Cited

OTHER PUBLICATIONS in a Model of Postinflammatory Hypersensitivity. The Journal of pharmacology and experimental therapeutics, 2006;319(1):447-458.
Distrutti, et al., Gut Microbiota role in irritable bowel syndrome: New therapeutic strategies. World Journal of Gastroenterology. Feb. 21, 2016; 22(7): p. 2219-2241, XP002769875.
Distrutti, et al., Hydrogen sulphide induces u opioid receptor-dependent analgesia in a rodent model of visceral pain. Molecular Pain, 2010; 6(36):1-16.
Divyashri et al. Probiotic attributes, antioxidant, anti-inflammatory and neuromodulatory effects of Enterococcus faecium CFR 3003: in vitro and in vivo evidence. (2015) J Med Microbiol, doi: 10.1099/jmm.0.000184.
DMSZ: Opening of Ampoules and Rehydration of Dried Cultures; (http://web.archive.org/web/20000 52411541 O/www.dsmz.de/open. htm); updated of website on Mar. 2000.
Dollard, S.C., et al., Activation of nuclear factor kB in brains from children with HIV-I encephalitis, Neuropathol Appl Neurobiol.Dec. 1995;21(6):518-28.
Dong, H., Rowland I Fau—Yaqoob, P., and Yaqoob, P. (2012). Comparative effects of six probiotic strains on immune function in vitro. Br J Nutr 108(3), 459-470. doi: 10.1017/S0007114511005824.
Dong-Hyun Kim and Young-Ho Jin, "Intestinal Bacterial B-Glucuronidase Activity of Patients with Colon Cancer", Arch Pharm Res vol. 24, No. 6, 564-567, 2001.
Drago, Lorenzo et al., Immunodulatory Effects of Lactobucillus salivarius LS01 and Bifidobacterium breve, Alone and in Combination on Peripheral Blood Mononuclear Cells of Allergic Asthmatics; Allergy Asthma Immunol. Res. Jul. 2015: 7(4):409-413.
Duck et al. 'Isolation of flagellated bacteria implicated in Crohn's disease.' Inflammatory Bowel Diseases. 2007, vol. 13, No. 10, pp. 1191-1201.
Duncan et al. (2002) "*Roseburia intestinalis* sp. nov., a novel saccharolytic, butyrate-producing bacterium from human faeces," International Journal Systematic Evolutionary Microbiology. 52:1615-1620.
Duncan et al. (2006) "Proposal of *Roseburia faecis* sp. nov., *Roseburia hominis* sp. nov. and *Roseburia inulinivorans* sp. nov., based on isolates from human faeces," International Journal of Systematic and Evolutionary Microbiology. vol. 56, No. Pt 10, pp. 2437-2441.
Duncan et al. "Lactate-utilizing bacteria, isolated from human feces, that produce butyrate as a major fermentation product" Applied and environmental microbiology. 2004, vol. 70, No. 10, pp. 5810-5817.
Duncan, et al. *Roseburia intestinalis* sp. nov., a novel saccharolytic, butyrate-producing bacterium from human faeces. Int J Syst Evol Microbiol. Sep. 2002;52(Pt 5):1615-20.
Durand et al., "Reductive Acetogenesis in Animal and Human Gut." Physiological and Clinical Aspects of Short-Chain Fatty Acids, 1995. pp. 107-117, XP000979817 Cambridge University Press ISBN 0-521-44048-3.
Dursun, Erdinç, The interleukin 1 alpha, interleukin 1 beta, interleukin 6 and alpha-2-macroglobulin serum levels in patients with early or late onset Alzheimer's disease, mild cognitive impairment or Parkinson's disease, Journal of Neuroimmunology 2015, 283, 50.
Eckburg, PB. et al., Diversity of the human intestinal microbial flora.Science. Jun. 10, 2005;308(5728):1635-8. Epub Apr. 14, 2005.
Elhenawy et al., Preferential packing of acidic glycosidases and proteases into bacteroides Outer membrane vesicles. mBio 5:e00909-14, pp. 1-12, 2014.
Elkins et al. 'Genes encoding bile salt hydrolases and conjugated bile salt transporters in Lactobacillus johnsonii 100-100 and other Lactobacillus species.' Microbiology. 2001, vol. 147, No. 12, pp. 3403-3412.
Elmadfa, 1., Klein, P., Meyer, AL. Immune-stimulating effects oflactic acid bacteria in vivo and in vitro (2010). Proceedings of the Nutrition Society, 69 (3), pp. 416-420.

Ely et al. (2000) "A family of six flagellin genes contributes to the Caulobacter crescentus flagellar filament," Journal of Bacteriology. 182(17):5001-5004.
Embl sequence AAO75294.1 (2003)—provided within the Office Action dated Feb. 16, 2018 in U.S. Appl. No. 15/631,952. 2 Pages.
Eren, A. Murat et al., "A single genus in the gut microbiome reflects host preference and specificity," The ISME Journal (2015) 9, 9-100 (2015).
ESR Dated Dec. 17, 2018, Appl. 18189521.0.
Estelle Devillard et al., Metabolism of Linoleic Acid by Human Gut Bacteria: Different Routes for Biosynthesis of Conjugated Linoleic Acid, Journal of Bacteriology, Mar. 2007, vol. 189, No. 4, pp. 2566-2570.
European Communication dated Jun. 14, 2017 for EP Application No. 15817513.3.
Evelo Biosciences, Inc. Clinical Trials (Rank 1): A Study of EDP1503 in Patients With Colorectal Cancer, Breast Cancer, and Checkpoint Inhibitor Relapsed Tumors, https://clinicaltrials.gov/ct2/show/NCT03775850?spons=evelo&rank=1,2018, accessed on Feb. 4, 2019.
Evelo Biosciences, Inc. Clinical Trials (Rank 2): A Study of EDP1815 in Healthy Participants and Participants With Mild to Moderate Psoriasis and Atopic Dermatitis, https://clinicaltrials.gov/ct2/show/NCT03733353?spons=evelo&rank=2, 2018, accessed on Feb. 4, 2019.
Evelo Biosciences, Inc. Clinical Trials (Rank 3): A Study of EDP1066 in Healthy Participants and Participants With Mild to Moderate Psoriasis and Atopic Dermatitis, https://clinicaltrials.gov/ct2/show/NCT03542994?spons=evelo&rank=3, 2018, accessed Feb. 4, 2019.
Evelo Biosciences, Inc. Clinical Trials (Rank 4): Pembrolizumab and EDP1503 in Advanced Melanoma, https://clinicaltrials.gov/ct2/show/NCT03595683?spons=evelo&rank=4, 2018, accessed Feb. 4, 2019.
Evelo Biosciences, Inc. Portfolio: https://evelobio.com/portfolio/, accessed Feb. 4, 2019.
Evelo Biosciences, Inc. website: https://evelobio.com/science/, accessed Feb. 4, 2019.
Extended European search report and opinion dated Aug. 23, 2016 for EP Application No. 16166001.4.
Fabro, A et al., The Th17 pathway in the peripheral lung microenvironment interacts with expression of collagen V in the late state of experimental pulmonary fibrosis. (2015) Immunobiology. 220(1):124-35.
Faghih, Z. et a., IL-17 and IL-4 Producing CD8+ T Cells in Tumor Draining Lymph Nodes of Breast Cancer Patients: Positive Association with Tumor Progression. (2013). Iranian Journal of Immunology. 10(4):193-204.
Fahy, J.V. Eosinophilic and neutrophilic inflammation in asthma: insights from clinical studies. Proc Am Thorac Soc. May 1, 2009;6(3):256-9. doi: 10.1513/pats.200808-087RM.
Faith et al. Identifying gut microbe-host phenotype relationships using combinatorial communities in gnotobiotic mice. Sci Transl Med 6(220):220ra11 (2014).
Faith et al. The long-term stability of the human gut microbiota. 2013. Science, 341(6141): 1237439.
Falony, et al., Coculture Fermentations of *Bifidobacterium* species and bacteroides thetaiotaomicron Reveal a mechanistic insight into the prebiotic effect of inulin-type Fructans. Applied and environmental microbiology, Apr. 2009;75(8):2312-2319.
Falony et al. In vitro kinetics of prebiotic inulin-type fructan fermentation by butyrate-producing colon bacteria: Implementation of online gas chromatography for quantitative analysis of carbon dioxide and hydrogen gas production. Applied and Environmental Microbiology. 2009, vol. 75, No. 18, pp. 5884-5892.
Fanning, S., Hall, L.J., Cronin, M., Zomer, A., MacSharry, J., Goulding, D., et al. (2012). Bifidobacterial surface-exopolysaccharide facilitates commensal-host interaction through immune modulation and pathogen protection. Proc Natl Acad Sci U S A 109(6), 2108-2113. doi: 10.1073/pnas.1115621109.
Farmer, et al., Gut pain & visceral hypersensitivity. British journal of pain, 2013;7(1):39-47.

(56) References Cited

OTHER PUBLICATIONS

Farooq, P.D. et al., Pseudomembranous colitis, Disease-A-Month 2015 Mosby Inc. USA, vol. 61, No. 5, May 1, 2015, pp. 181-206, XP009193313, ISSN: 0011-5029 p. 195.
FDA Orphan Drug Designations. Total Orphan Drugs website. Aug. 2014. Available at http://www.orphan-drugs.org/2014/09/01/fda-orphandrug- designations-august-2014. Accessed on Apr. 13, 2016.
Federico E. Rey et al., "Dissecting the in Vivo Metabolic Potential of Two Human Gut Acetogens", The Journal of Biological Chemistry, vol. 285, No. 29, pp. 22082-22090, Jul. 16, 2010.
Fenner, et al., *Bacteroides massiliensis* sp. nov., isolated from blood culture of a newborn. International Journal of systematic and evolutionary microbiology, 2005. 55: 1335-1337.
Ferrario, C., Milani, C., Mancabelli, L., Lugli, G.A., Duranti, S., Mangifesta, M., et al. (2016). Modulation of the eps-ome transcription of bifidobacteria through simulation of human intestinal environment. FEMS Microbiol Ecol 92(4), fiw056. doi: 10.1093/femsec/fiw056.
Flores-Langarica et al. (2012) "Systemic flagellin immunization stimulates mucosal CD1 03+ dendritic cells and drives Foxp3+ regulatory T Cell and IgA responses in the mesenteric lymph node," Journal of Immunology. 189 (12):57 45-5754.
Foguem & Manckoundia, "Lewy Body Disease: Clinical and Pathological "Overlap Syndrome" Between Synucleinopathies (Parkinson Disease) and Tauopathies (Alzheimer Disease)", 2018, Current Neurology and Neuroscience Reports, 18:24.
Forman, Mark S. et al., Signature Tau Neuropathology in Gray and White Matter of Corticobasal Degeneration, American Journal of Pathology, 2002, vol. 160, No. 6, 2045-2053.
Fraley et al. (1986) "Genetic Transformation in Higher Plants," Critical Reviews Plant Science. 4:1-46.
Frame et al., Production offertile transgenic maize plants by silicon carbide whisker-mediated transformation, The Plant Journal. 1994; 6:941-948.
Frank, D. et al., Molecular-phylogenetic characterization of microbial community imbalances in human inflammatory bowel diseases. 2007. PNAS. 104(34):13780-5.
Frick, et al., Identification of commensal bacterial strains that modulate Yersinia enterocolitica and Dextran sodium sulfate-induced inflammatory responses: implications for the development of probiotics. Infection and immunity, Jul. 2007;75(7):3490-3497.
Gaboriau-Routhiau et al. 'The key role of segmented filamentous bacteria in the coordinated maturation of gut helper T cell responses.' Immunity. 2009, vol. 31, No. 4, pp. 677-689.
Gait, M.J., (1984) Oligonucleotide Synthesis: A Practical Approach. Irl Press, pp. vii-xiii.
Galimberti, D. et al. Inflammatory molecules in Frontotemporal Dementia: Cerebrospinal fluid signature of progranulin mutation carriers. Brain Behavior and Immunity 49:182-187 (2015).
Galpern & Lang, "Interface between tauopathies and synucleinopathies: A tale of two proteins" 2006, Neurological Progress 59, 3, 449-458.
GB Exam and search report dated Aug. 30, 2016 for GB Application No. 1520638.6.
GB Search and Exam report dated Mar. 31, 2016 for GB application 1510469.8.
GB Search and Exam report dated Mar. 31, 2016 for GB application 1510470.6.
GB Search and Exam report dated Apr. 15, 2016 for GB application 1510467.2.
GB Search and Exam report dated Apr. 20, 2016 for GB application 1510466.4.
GB Search and Exam report dated Apr. 20, 2016 for GB application 1510468.0.
GB Search and Exam report dated Aug. 30, 2016 for GB application No. 1520631.1.
GB Search and Exam report dated Nov. 17, 2016 for GB application 1520502.4.
GB Search and Exam report dated Sep. 13, 2016 for GB application 1520497.7.
GB1612190.7 International Search Report dated Apr. 12, 2017.
GB1809729.5 Examination Report dated Oct. 15, 2018.
GenBank Accession No. ABI48297.1 (Jul. 20, 2007) "Fia1 flagellin [Roseburia hominis]".
GenBank Accession No. ABY J02000000 (Nov. 8, 2013) Version 2. "Roseburia intestinal is L 1-82, whole genome shotgun sequencing project".
GenBank Accession Nos. ABY J02000001-ABY J02000409 search results page (Last Updated Apr. 24, 2015).
GenBank accession No. AJ312385 (Oct. 9, 2002) "Roseburia intestinalis 16S rRNA gene, strain L 1-82".
GenBank Accession No. CP003040 (Aug. 5, 2011) Version 1. "Roseburia Hominis A2-183, complete genome".
GenBank Accession No. DQ789141. (Jul. 20, 2007) "Roseburia hom in is Fla2 flagellin gene".
GenBank Accession No. M20983. (Apr. 26, 1993) "R.cecicola ftagellin gene".
GenBank Accession No. NR_044054.1 (Feb. 3, 2015) Blautia wexlerae strain SSM 19850 16S ribsomal RNA gene, partial sequence.
GenBank Accession No. NR_117867.1 (Feb. 3, 2015) Blautia stercoris strain GAM6-1 16S ribsomal RNA gene, partial sequence.
Genbank NCBI Reference Sequence: NR-044054.1, Blautia wexlerae strain DSM 19850 16S ribosomal RNA gene, partial sequence.
Genbank NCBI Reference Sequence: NR_117867.1, Blautia stercoris strain GAMC6-1 16S ribosomal RNA gene, partial sequence.
Genbank NCBI Reference Sequence: NR_026314, Blautia hydrongentrophica strain S5a36 16S ribosomal RNA gene, partial sequence.
Gennaro, A.R. "Quality Assurance and Control," from Remington: The Science and Practice of Pharmacy, 2000, Lippincott Williams & Wilkins, 20th ed., pp. 980-983.
Geraedts et al. 'Release of satiety hormones in response to specific dietary proteins is different between human and murine small intestinal mucosa.' Annals of Nutrition and Metabolism. 2010, vol. 56, No. 4, pp. 3018-3313.
Geuking et al. 'Intestinal bacterial colonization induces mutualistic regulatory T cell responses.' Immunity. 2011, vol. 34, No. 5, pp. 794-806.
Gewirtz et al. (2001) Cutting edge: bacterial flagellin activates basolaterally expressed TLR5 to induce epithelial proinflammatory gene expression. The Journal of Immunology. 167:(4)1882-1885.
Ghadimi, D. et al., Epigenetic imprinting by commensal probiotics inhibits the IL-23/IL-17 axis in an in vitro model of the intestinal mucosal immune system. JLB. 2012;92(4):895-911.
Giraud et al. 'Dissecting the genetic components of adaptation of *Escherichia coli* to the mouse gut.' PLoS Genetics.2008, vol. 4, No. 1, pp. e2.
Goldin, B.R. et al., Clinical indications for probiotics: an overview. Clin Infect Dis. Feb. 1, 2008;46 Suppl 2:S96-100; discussion S144-51. doi: 10.1086/523333.
Gong, Chun-Yu et al., Targeting the kynurenine pathway as a potential strategy to prevent and treat Alzheimer's disease,Medical Hypotheses,vol. 77, Issue 3, Sep. 2011, pp. 383-385.
Gonzalez-Rodriguez, I., Sanchez, B., Ruiz, L., Turroni, F., Ventura, M., Ruas-Madiedo, P., et al. (2012). Role of extracellular transaldolase from Bifidobacterium bifidum in mucin adhesion and aggregation. Appl Environ Microbiol 78(11), 3992-3998. doi: 10.1128/AEM.08024-11.
Gopal, P.K., Sullivan, P.A., Smart, J.B. Utilization of galacto-oligosaccharides as selective substrates for growth by lactic acid bacteria including Bifidobacterium lactis DR10 and Lactobacillus rhamnosus DR20 (200 1 ). International Dairy Journal, 11 (1-2), pp. 19-25.
Gousia, P., et al., Antimicrobial resistance of major foodbome pathogens from major meat products (20II). Foodborne Pathogens and Disease, 8 (1), pp. 27-38.
Graff and Tsai, The Potential of HDAC Inhibitors as Cognitive Enhancers, Annu. Rev. Pharmacol. Toxicol. 2013. 53:311-30.
Greenspan et al., Defining epitopes: It's not as easy as it seems. Nature Biotechnology 7: 936-937, 1999.
Groeger, D., O'Mahony, L., Murphy, E.F., Bourke, J.F., Dinan, T.G., Kiely, B., et al. (2013). Bifidobacterium infantis 35624 modulates host inflammatory processes beyond the gut. Gut Microbes 4(4), 325-339. doi: 10.4161/gmic.25487.

(56) References Cited

OTHER PUBLICATIONS

GT Biologies obtains FDA orphan drug designation for paediatric crohn's drug, pharmaceutical-technology.com news, Oct. 8, 2013. Available at: http://www.pharmaceutical-technology.com/news/newsgt-biologics-obtains-fda-orphan-drug-designation-for-paediatric-crohns-drug?WT.mc_id=DN_News.

Guidi, Ilaria et al., Oxidative imbalance in patients with mild cognitive impairment and Alzheimer's disease,Neurobiology of Aging,vol. 27, Issue 2, Feb. 2006, pp. 262-269.

Haabeth et al. A model for cancer-suppressive inflammation. (2012) OncoImmunology 1(1):1146-1152.

Hammerich, L. et al., Interleukins in chronic liver disease: lessons learned from experimental mouse models. (2014) Clin Exp Gastroenterol. 7:297-306.

Hansen, et al., The role of mucosal immunity and host genetics in defining intestinal commensal bacteria. 2010. Curr. Opin. Gastroenterol., 26(6): 564-571.

Hansjörg Rindt, Zhihua Feng, Chiara Mazzasette, Jacqueline J. Glascock, David Valdivia, Noah Pyles, Thomas O. Crawford, Kathryn J. Swoboda, Teresa N. Patitucci, Allison D. Ebert, Charlotte J. Sumner, Chien-Ping Ko, Christian L. Lorson, Astrocytes influence the severity of spinal muscular atrophy, Human Molecular Genetics, vol. 24, Issue 14, Jul. 15, 2015, pp. 4094-4102,https://doi.org/10.1093/hmg/ddv148.

Hapfelmeier et al. 'Reversible microbial colonization of germ-free mice reveals the dynamics of IgA immune responses.' Science. 2010, vol. 328, No. 5986, pp. 1705-1709.

Hasegawa, Satoru et al., Intestinal Dysbiosis and Lowered Serum Lipopolysaccharide-Binding Protein in Parkinson's Disease, PLOS One, 2015, pp. 1-15.

Hayashi et al. The innate immune response to bacterial flagellin is mediated by Toll-like receptors. Nature. 2001, vol. 410, No. 6832, pp. 1099-1103.

Heberle, H., Meirelles, G.V., da Silva, F.R., Telles, G.P., and Minghim, R. (2015). InteractiVenn: a web-based tool for the analysis of sets through Venn diagrams. BMC Bioinformatics 16(1), 169. doi: 10.1186/s12859-015-0611-3.

Hedayat et al. (Mar. 1, 2012) "Prophylactic and therapeutic implications of toll-like receptor ligands," Medicinal Research Reviews. 32(2):294-325.

Heuvelin, E., Lebreton, C., Grangette, C., Pot, B., Cerf-Bensussan, N., and Heyman, M. (2009). Mechanisms Involved in Alleviation of Intestinal Inflammation by Bifidobacterium Breve Soluble Factors. Plos One 4(4), e5184. doi: 10.1371/journal.pone.0005184.

Heyser, Charles J et al., Progressive decline in avoidance learning paralleled by inflammatory neurodegeneration in transgenic mice expressing interleukin 6 in the brain, Proc. Natl. Acad. Sci. USA vol. 94, pp. 1500-1505, Feb. 1997.

Hidalgo-Cantabrana, C., Lopez, P., Gueimonde, M., de Los Reyes-Gavilan, C.G., Suarez, A., Margolles, A., et al. (2012). Immune Modulation Capability of Exopolysaccharides Synthesised by Lactic Acid Bacteria and Bifidobacteria. Probiotics Antimicrob Proteins 4(4), 227-237. doi: 10.1007/s12602-012-9110-2.

Hidalgo-Cantabrana, C., Sanchez, B., Alvarez-Martin, P., Lopez, P., Martinez-Alvarez, N., Delley, M., et al. (2015). A single mutation in the gene responsible for the mucoid phenotype of *Bifidobacterium animalis* subsp. lactis confers surface and functional characteristics. Appl Environ Microbiol 81(23), 7960-7968. doi: 10.1128/AEM.02095-15.

Hidalgo-Cantabrana, C., Sanchez, B., Milani, C., Ventura, M., Margolles, A., and Ruas-Madiedo, P. (2014). Genomic overview and biological functions of exopolysaccharide biosynthesis in *Bifidobacterium* spp. Appl Environ Microbiol 80(1), 9-18. doi: 10.1128/AEM.02977-13.

Higgins, et al. Clustal: A Package for Performing Multiple Sequence Alignment on a Microcomputer. Gene. 73 (1988): 237-244.

Hinchliffe (1993) "Yeast as a vehicle for the expression of heterologous genes," Yeasts. 2nd edition. Rose, A. R.; Harrison, J. H.: Eds. Academic Press Ltd. 5(9). pp. 325-356.

Hinnen et al., Transformation of yeast, Proc. Natl. Acad. Sci. USA. Apr. 1978; 75:1929-1933.

Hoarau, Cyrille et al., Supernatant from Bifidobacterium Differentially Modulates Transduction Signaling Pathways for Biological Functions of Human Dendritic Cells, Plos One, Public Library of Science, US, vol. 3, No. 7, Jul. 1, 2008 (Jul. 1, 2008), p. e2753-1, XP009139666,ISSN: 1932-6203 *cf. abstract and conclusion, furthermore discussion part at p. 3, col. at the right side*.

Hoarau et al: "TLR2 Activation By Supernatant From Bifidobacterium Breve Modulates Maturation and Survival of Human DCs Via Differential Effects on PI3Kinase, p38 and ERK Pathways",Journal of Allergy and Clinical Immuno, Elsevier, Amsterdam, NL, vol. 119, No. 1, Jan. 1, 2007 (Jan. 1, 2007), p. S258, XP005756921, ISSN: 0091-6749, DOI: 10.1016/J.JACI.2006.12.377 *cf. abs.No. 1008 at p. S258*.

Hoekema (1985) The Binary Plant Vector System Offset-drukkerij Kanters BB, Alblasserdam. Chapter V. pp. 63-71.

Hold et al. 'Oligonucleotide probes that detect quantitatively significant groups of butyrate-producing bacteria in human feces.' Applied and environmental microbiology. 2003, vol. 69, No. 7, pp. 4320-4324.

Holdeman, et al., Eubacterium contortum (Prevot) comb, nov.: Emendation of description and designation of the type strain. International journal of systematic bacteriology. Oct. 1971;21(4): 304-306.

Holland et al. (1990) "Secretion of Heterologous Proteins in *Escherichia coli*," Methods Enzymology. 182:132-143.

Hollenberg et al. (1997) "Production of recombinant proteins by methulotrophic yeasts," Current Opinion Biotechnology. 8(5):554-560.

Hooper at al. 'Molecular analysis of commensal host-microbial relationships in the intestine.' Science. 2001; vol. 291, No. 5505, pp. 881-884.

Horn, et al., Synthesis of Oligonucleotides on Cellulose. Part II: Design and Synthetic Strategy to the Synthesis of 22 Oligodeoxynucleotides Coding for Gastric Inhibitory Polypeptide (GIP). 1980. Nuc Acids Res Symp Ser 225-232.

Horwell, et al., The 'peptoid' approach to the design of non-peptide, small molecule agonists and antagonists of neuropeptides. 1995. Trends Biotechnol. 13(4):132-134.

Hossain et al. "Flagellin, a TLR5 agonist, reduces graft-versus-host disease in allogeneic hematopoietic stem cell transplantation recipients while enhancing antiviral immunity," Journal of Immunology. Nov. 2011; 187(10): p. 5130-5140.

Hougee, et al., Oral treatment with probiotics reduces allergic symptoms in ovalbumin-sensitized mice:a bacterial strain comparative study. Int Arch Allergy Immunol. 2010; 151:107-117.

Hoyles L. et al. Gastrointestinal Tract, Chapter 56. Handbook of Hydrocarbon and Lipid Microbiology Springer Verlag Berlin 2010, 3120-32.

https://www.aphasia.org/aphasia-resources/primary-progressive-aphasia/,retrieved on Apr. 1, 2020.

Hughes, K.R., Harnisch, L.C., Alcon-Giner, C., Mitra, S., Wright, C.J., Ketskemety, J., et al. (2017). Bifidobacterium breve reduces apoptotic epithelial cell shedding in an exopolysaccharide and MyD88-dependent manner. Open Biol 7(1). doi: 10.1098/rsob.160155.

Hytönen, J., Haataja, S., and Finne, J. (2003). *Streptococcus pyogenes* Glycoprotein-Binding Strepadhesin Activity Is Mediated by a Surface-Associated Carbohydrate-Degrading Enzyme, Pullulanase. Infection and Immunity 71(2), 784-793.

Hytonen, J., Haataja, S., and Finne, J. (2006). Use of flow cytometry for the adhesion analysis of *Streptococcus pyogenes* mutant strains to epithelial cells: investigation of the possible role of surface pullulanase and cysteine protease, and the transcriptional regulator Rgg. BMC Microbiol 6, 18. doi: 10.1186/1471-2180-6-18.

Ibrahim et al., "Method for the isolation of highly purified *Salmonella* flagellins," Journal of Clinical Microbiology. Dec. 1985; 22(6):1040-1044.

Imamura, K., Hishikawa, N., Ono, K. et al. Cytokine production of activated microglia and decrease in neurotrophic factors of neurons in the hippocampus of Lewy body disease brains.Acta Neuropathol 109,141-150 (2005). https://doi.org/10.1007/s00401-004-0919-y.

(56) References Cited

OTHER PUBLICATIONS

Inaba et al., "Generation of large numbers of dendritic cells from mouse bone marrow cultures supplemented with granulocyte/macrophage colony-stimulating factor," J. Exp. Med. Dec. 1992; 176(6):1693-1702.
Interational Search Report for International Application No. PCT/GB2012/052495, dated Mar. 25, 2013.
International Preliminary Report dated Mar. 1, 2017 for International Application No. PCT/GB2015/054113.
International Preliminary Report on Patentability corresponding to International Patent Application No. PCT/GB2014/051123, dated Oct. 13, 2015.
International Preliminary Report on Patentability for International Application No. PCT/GB2012/051686 dated Jan. 14, 2014.
International Search Report dated Jan. 27, 2017 for International Application No. PCT/GB2016/053622.
International Search Report dated Feb. 10, 2016 for International Application No. PCT/GB2015/054113.
International Search Report dated Feb. 17, 2017 for International Application No. PCT/GB2016/053676.
International Search Report dated Mar. 7, 2016 for International Application No. PCT/GB2015/054112.
International Search report dated Mar. 15, 2003 for International Application No. PCT/GB2002/05255.
International Search Report dated Aug. 21, 2014 for International Application No. PCT/GB2014/051123.
International Search Report dated Aug. 26, 2016 for International application No. PCT/GB2016/051774.
International Search Report dated Aug. 26, 2016 for International application No. PCT/GB2016/051776.
International Search Report dated Sep. 6, 2016 for International application No. PCT/GB2016/051768.
International Search Report dated Sep. 6, 2016 for International application No. PCT/GB2016/051773.
International Search Report dated 09/06/2016for International application No. PCT/GB2016/051770.
International Search Report dated Feb. 2, 2017 for International application No. PCT/GB2016/053620.
International Search Report dated Mar. 6, 2017 for International Application No. PCT/GB2016/053677.
International Search Report for International Application No. PCT/GB2012/051686 dated Jan. 31, 2013.
International search report with written opinion dated Feb. 26, 2018 for PCT/GB2017/053722.
International search report with written opinion dated Jun. 8, 2017 for GB Application No. 1616016.
International search report with written opinion dated Sep. 29, 2017 for GB Application No. 1621123.
International search report with written opinion dated Oct. 16, 2017 for PCT/GB2017/052076.
Inturri, R., Molinaro, A., Di Lorenzo, F., Blandino, G., Tomasello, B., Hidalgo-Cantabrana, C., et al. (2017). Chemical and biological properties of the novel exopolysaccharide produced by a probiotic strain of Bifidobacterium longum. Carbohydr Polym 174, 1172-1180. doi: 10.1016/j.carbpol.2017.07.039.
Ishikawa, et al., Effect of bifidobacteria to suppress Th17, Food Science and technology institute, 2008, 5 Pages.
Ispirli, H. et al., Characterization of functional properties of Enterococcus faecium strains isolated from human gut.Can. J. Microbiol. 61: 861-870 (2015) dx.doi.org/10.1139/cjm-2015-0446.
Israel, E. et al., Supplementary Appendix, Severe and difficult-to-treat asthma in adults. N. Engl J Med 2017;p377:965-76. DOI: 10.1056/NEJMra1608969.
Israel, et al., Severe and difficult-to-treat asthma in adults, The New England Journal of Medicine, Sep. 2017; 377(10):965-976.
Issue Notification dated Feb. 20, 19 for Co-Pending U.S. Appl. No. 15/631,945.
Ito et al. (1983) "Transformation of Intact Yeast Cells Treated with Alkali Cations," J. Bacteriology. 153:163-168.

Ivanov, D., Emonet, C., Foata, F., Affolter, M., Delley, M., Fisseha, M., et al. (2006). A serpin from the gut bacterium Bifidobacterium longum inhibits eukaryotic elastase-like serine proteases. J Biol Chem 281(25), 17246-17252. doi: 10.1074/jbc.M601678200.
Ivanov et al. 'Induction of intestinal Th17 cells by segmented filamentous bacteria.' Cell. 2009, vol. 139, No. 3, pp. 485-498.
Jackson MS, Bird AR, McOrist AL. Comparison of two selective media for the detection and enumeration of Lactobacilli in human faeces (2002). J Microbial Methods. 51 (3), pp. 313-321.
Jagveer Singh et al., "Bifidobacterium longum, a lactic acid-producing intestinal bacterium inhibits colon cancer and modulates the intermediate biomarkers of colon carcinogenesis", Carcinogenesis vol. 18 No. 4 pp. 833-841, 1997.
Jarchum et al., "Toll-Like Receptor 5 Stimulation Protects Mice from Acute Clostridium difficile Colitis," Infection and Immunity. Apr. 2011; 79(4):1498-1503.
Jawad, S. et al., Elevated serum levels of interleukin-17A in uveitis patients. Ocul Immunol Inflamm. Dec. 2013;21(6):434-9. doi: 10.3109/09273948.2013.815786. Epub Aug. 19, 2013.
Jeanne-Claire Lesbordes, Carmen Cifuentes-Diaz, Audrey Miroglio, Vandana Joshi, Thierry Bordet, Axel Kahn, Judith Melki, Therapeutic benefits of cardiotrophin-1 gene transfer in a mouse model of spinal muscular atrophy, Human Molecular Genetics, vol. 12, Issue 11, Jun. 1, 2003, pp. 1233-1239,https://doi.org/10.1093/hmg/ddg143.
Jenq, Robert R., Intestinal Bluatia is associated with reduced death from graft versus-host disease, Bio Blood Marro Transplant. Aug. 2015; 21(8): 1373-1383. doi:10.1016/j.bbmt.2015.04.016.
Jeon, S.G., Kayama, H., Ueda, Y., Takahashi, T., Asahara, T., Tsuji, H., et al. (2012). Probiotic Bifidobacterium breve induces IL-10-producing Tr1 cells in the colon. PLoS Pathog 8(5), e1002714. doi: 10.1371/journal.ppat.1002714.
Jiao et al., Blockade of Notch Signaling Ameliorates Murine Collagen-Induced Arthritis via Suppressing Th1 and Th17 Cell Responses. 2014; Pathology, 184(4):1085-1093.
Joblin K N., "Ruminal Acetogens and Their Potential to Lower Remnant Methane Emissions." Australian Journal of Agricultural Research, vol. 50. No. 8. 1999, pp. 1307-1313. XP001010439.
Kailasapathy, K. Microencapsulation of Probiotic Bacteria:Technology and Potential Applications. Curr. Issues Intest. Microbiol. (2002) 3: 39-48.
Kaltschmidt,Barbara et al., Transcription factor NF-κB is activated in primary neurons by amyloid β peptides and in neurons surrounding early plaques from patients with Alzheimer disease, PNASMarch 18, 199794(6)2642-2647;https://doi.org/10.1073/pnas.94.6.2642.
Kanauchi, et al., Eubacterium limosum ameliorates experimental colitis and metabolite of microbe attenuates colonic inflammatory action with increase of mucosal integrity introduction, China World J Gastroenterol February, Jan. 1, 2006. pp. 1071-1077.
Kanauchi, et al., Eubacterium limosum (probiotic) and its metabolites showed anti-inflammatory effects and increased mucosal barrier function in colitis. Gastroenterology, 2005;128: p. A281, XP009193489.
Kang et al. (2010) "Dysbiosis of fecal microbiota in Crohn's disease patients as revealed by a custom phylogenetic microarray," Inflammatory Bowel Diseases. 16(12):2034-2042.
Kang, S. et al., Dysbiosis of fecal microbiota in Crohn's disease patients as revealed by a custom phylogenetic microarray.Inflamm Bowel Dis. Dec. 2010;16(12):2034-42. doi: 10.1002/ibd.21319.
Karaffova, et al., Interaction of TGF-B4 and IL-17 with IgA secretion in the intestine of chickens fed with E. faecium AL41 and challenged with S. Enteritidis. Research in Veterinary science. 2015:75-79.
Kari Shoaf et al., "Prebiotic Galactooligosaccharides Reduce Adherence of Enteropathogenic *Escherichia coli* to Tissue Culture Cells", Infection and Immunity, Dec. 2006, vol. 74. No. 12, p. 6920-6928.
Karin, M. Nuclear factor-kappaB in cancer development and progression. Nature. May 25, 2006;441(7092):431-6.
Kazantsev, A., Thompson, L. Therapeutic application of histone deacetylase inhibitors for central nervous system disorders. Nat Rev Drug Discov 7,854-868 (2008). https://doi.org/10.1038/nrd2681.
Keller et al.. "DNA Probes", 1994. Stockton Press. New York. XP002158943 108660 pp. 594-596.

(56) References Cited

OTHER PUBLICATIONS

Kelly et al. 'Commensal anaerobic gut bacteria attenuate inflammation by regulating nuclear-cytoplasmic shuttling of PPAR-y and ReiA.' Nature Immunology. 2003, vol. 5, No. 1, pp. 104-112.
Kelly, et al., Commensal gut bacteria: mechanisms of immune modulation. TRENDS in immunology, 2005;26(6):326-333.
Keshavarzian MD., Ali et al., "Colonic Bacterial Composition in Parkinson's Disease", Movement Disorders, 2015, vol. 30, No. 10, 1351-1360.
Khoshnan, Ali et al. "Activation of the IkappaB kinase complex and nuclear factor-kappaB contributes to mutant huntingtin neurotoxicity." The Journal of neuroscience : the official journal of the Society for Neuroscience vol. 24,37 (2004): 7999-8008. doi:10.1523/JNEUROSCI.2675-04.2004.
Kingsley M. A Personalized Approach to Managing 18D. Gastroenterology and Hepatology 12(5)308-315, May 2016.
Kinnebrew et al., Interleukin 23 production by intestinal CD1 03(+)CD11 b(+) dendritic cells in response to Interleukin 23 production by intestinal CD1 03(+ )CD11 b(+) dendritic cells in response to bacterial flagellin enhances mucosal innate immune defense, Immunity. 2012; 36(2): 276-287.
Kinoshita, H., Uchida, H., Kawai, Y., Kawasaki, T., Wakahara, N., Matsuo, H., et al. (2008). Cell surface Lactobacillus plantarum LA 318 glyceraldehyde-3-phosphate dehydrogenase (GAPDH) adheres to human colonic mucin. J Appl Microbiol 104(6), 1667-1674. doi: 10.1111/j.1365-2672.2007.03679.x.
Kirsty Minton: Mucosal immunology: The ins and outs of gut inflammation, The journal of immunology, 4(2), Feb. 1, 2004: pp. 81-81, XP055252701.
Kishimoto, M., Nomoto, R., Mizuno, M., and Osawa, R. (2017). An in vitro investigation of immunomodulatory properties of Lactobacillus plantarum and L. delbrueckii cells and their extracellular polysaccharides. Bioscience of Microbiota, Food and Health 36(3), 101-110. doi: 10.12938/bmfh.17-001.
Kitahara et al., *Bacteroides plebeius* sp. nov. and *Bacteroides coprocola* sp. nov., isolated from human faeces, 2005; Int J Syst Ev Microbiol 55: 2143-47.
Kitahara, M. et al., *Bacteroides plebeius* sp. nov. and *Bacteroides coprocola* sp. nov., isolated from human faeces. International journal of systematic and evolutionary microbiology. 2005; 55: 2143-2147.
Koenders, M.I. et al., Interleukin-17 Acts Independently of TNF-a under Arthritic Conditions. (2006) J. Immunol. 176:6262-6269.
Kogyo, S. Lactic Acid Bacteria, Intestinal Flora ad Health II; Physiological effects of heat-treated lactococcus "EF-2001" and application to food. Mar. 3, 20010, vol. 44, No. 6, pp. 35-39.
Koh, Gar Yee et al., Parabacteroides distasonis attenuate toll-like receptor 4 signalling and Akt activation and blocks colon tumor formulation in high-fat-diet-fed azoxymethane-treated mice, International Journal of Cancer, pp. 1-30. Accepted Article, doi: 10.1002/ijc.31559.
Korhonen, J.M., Sclivagnotis, Y., Von Wright, A Characterization of dominant cultivable lactobacilli and their antibiotic resistance profiles from faecal samples of weaning piglets (2007). Journal of Applied Microbiology, 103 (6), pp. 2496-2503.
Kumolosasi, E., Salim, E., Jantan, I., and Ahmad, W. (2014). Kinetics of Intracellular, Extracellular and Production of Pro-Inflammatory Cytokines in Lipopolysaccharide-Stimulated Human Peripheral Blood Mononuclear Cells. Tropical Journal of Pharmaceutical Research 13(4), 536-543. doi: 10.4314/tjpr.v13i4.8.
Kverka, M. et al., Oral administration of Parabacteroides distasonis antigens attenuates experimental murine colitis through modulation of immunity and microbiota composition. Clinical & Experimental Immunology. 2010; 163:250-259.
Laetitia Rodes et al., "Microencapsulated *Bifidobacterium longum* subsp. infantis ATCC 15697 Favorably Modulates Gut Microbiota and Reduces Circulating Endotoxins in F344 Rats", BioMed Research International, vol. 2014, Article ID 602832, 11 pages.
Lahteinen, T., et al., A Pro biotic properties of Lactobacillus isolates originating from porcine intestine and feces (20 10) Anaerobe, 16 (3), pp. 293-300.
Lakhdari, et al. Identification of NF-KB Modulation Capabilities within Human Intestinal Commensal Bacteria. J Biomed Biotechnol. 2011; 2011: 282356.
Laukova, A. et al. Benefits of Combinative Application of Probiotic, Enterocin M-Producing Strain Enterococcus Faecium AL41 and Eleutherococcus Senticosus in Rabbits. Folia Microbiol (Praha) 61 (2), 169-177. Sep. 9, 2015.
Laureen Crouzet et al., "The altered gut microbiota of IBS patients plays a key role in visceral hypersensitivity: specific role of sulphate-reducing bacteria", INRA Symposium, 2012.
Lavallie et al. (1995) "Gene fusion expression systems in *Escherichia coli*," Current Opinion Biotechnology. 6 (5):501-506.
Law, J., Buist, G., Haandrikman, A., Kok, J., Venema, G., and Leenhouts, K. (1995). A system to generate chromosomal mutations in Lactococcus lactis which allows fast analysis of targeted genes. Journal of Bacteriology 177(24), 7011-7018.
Lazarini et al. , Modulation of prion protein gene expression by growth factors in cultured mouse astrocytes and PC-12 cells,1994 Mol Brain Res 22(1-4) 268-74.
Lazarini, Françoise et al., Modulation of prion protein gene expression by growth factors in cultured mouse astrocytes and PC-12 cells,Molecular Brain Research 22 (1994) 268-274.
Lebeer, S., Claes, I.J., Verhoeven, T.L., Vanderleyden, J., and De Keersmaecker, S.C. (2011). Exopolysaccharides of Lactobacillus rhamnosus GG form a protective shield against innate immune factors in the intestine. Microb Biotechnol 4(3), 368-374. doi: 10.1111/j.1751-7915.2010.00199.x.
Lebeer, S., Verhoeven, T.L., Francius, G., Schoofs, G., Lambrichts, I., Dufrene, Y., et al. (2009). Identification of a Gene Cluster for the Biosynthesis of a Long, Galactose-Rich Exopolysaccharide in Lactobacillus rhamnosus GG and Functional Analysis of the Priming Glycosyltransferase. Appl Environ Microbiol 75(11), 3554-3563. doi: 10.1128/AEM.02919-08.
Lee Do Yeon et al., "Kynurenic acid attenuates MPP—induced dopaminergic neuronal cell death via a Bax-mediated mitochondrial pathway",2008, European Journal of Cell Biology 87:389-397.
Lee, et al. Intestinal microbiota in pathophysiology and management of irritable bowel syndrome . 2014. World J Gastroenterol. 20(27): 8886-8897.
Lejeune et al. Efficiency of Recombinant Human TNF in Human Cancer Therapy. Cancer Immun. 6:6 (2006).
Leser et al. 'Culture-independent analysis of gut bacteria: the pig gastrointestinal tract microbiota revisited'. Applied and Environmental Microbiology. 2002, vol. 68, No. 2, pp. 673-690.
Leslie, et al., Trehalose and sucrose protect both membranes and proteins in intact bacteria during drying. (1995) Appl. Environ. Microbiol. 61, 3592-3597.
Letran et al. 'TLR5-deficient mice lack basal inflammatory and metabolic defects but exhibit impaired CD4 T cell responses to a ftagellated pathogen.' The Journal of Immunology. 2011, vol. 186, No. 9, pp. 5406-5412.
Li, C.Y., Lin Hc Fau—Lai, C.-H., Lai Ch Fau—Lu, J.J.-Y., Lu Jj Fau—Wu, S.-F., Wu Sf Fau—Fang, S.-H., and Fang, S.H. (2011). Immunomodulatory effects of lactobacillus and Bifidobacterium on both murine and human mitogen-activated T cells. Int Arch Allergy Immunol 156(2), 128-136. doi: 10.1159/000322350.
Li, et al.,. Screening and Identification of Lactobacillus animalis strain and characteristics of its bacteriostatic protein, Weishengwuxue Tongbao 2009; 36(7): 1001-1007.
Lilley et al., Methods in Enzymology; DNA Structure Part A: Synthesis and Physical Analysis of DNA. 1992; vol. 2011. pp. v-vii.
Lin, M., Beal, M. Mitochondrial dysfunction and oxidative stress in neurodegenerative diseases. Nature 443,787-795 (2006). https://doi.org/10.1038/nature05292.
Liu, Chang-jian et al., Antioxidant and Cholesterol-Reducing Properties of Enterococcus gallinarum m661, Bioengineering (Food Science), vol. 34, No. 7, Dec. 31, 2013, pp. 157-161.
Liu et al. Reclassification of Clostridium coccoides, Ruminococcus hansenii, Ruminococcus hydrogenotrophicus, Ruminococcus luti, Ruminococcus productus and Ruminococcus schinkii as *Blautia*

(56) References Cited

OTHER PUBLICATIONS

*coccoides* gen. nov., comb. nov., *Blautia hansenii* comb. nov., *Blautia hydrogenotrophica* comb. nov., *Blautia luti* comb. nov., *Blautia producta* comb. nov., *Blautia schinkii* comb. nov. and description of *Blautia wexlerae* sp. nov., isolated from human faeces. 2008. Int J Syst Evol Microbiol 58,1896-1902.
Liu, Y., et al., Human-derived probiotic Lactobacillus reuteri strains differentially reduce intestinal inflannuation (20 10). American Journal of Physiology—Gastrointestinal and Liver Physiology, 299 (5), pp. G1087-G1096.
Ljungh, A, Wadstrorn, T. Lactic acid bacteria as probiotics (2006). Current Issues in Intestinal Microbiology, 7 (2), pp. 73-90.
Lodemann, U. et al., Effects of the Probiotic enterococcus faecium and pathogenic *Escherichia coli* strains in a pig and human epithelial intestinal cell model. Hindawi publishing corporation scientifica. 2015(235184) 10 pages.
Lopetuso et al. Commensal Clostridia: leading players in the maintenance of gut homeostasis. 2013. Gut Pathogens, 5: 23.
Lopez, P., Gonzalez-Rodriguez, I., Sanchez, B., Ruas-Madiedo, P., Suarez, A., Margolles, A., et al. (2012). Interaction of Bifidobacterium bifidum LMG13195 with HT29 cells influences regulatory-T-cell-associated chemokine receptor expression. Appl Environ Microbiol 78(8), 2850-2857. doi: 10.1128/AEM.07581-11.
Lopez-Boado, Y. S. et al., Bacterial Exposure Induces and Activates Matrilysin in Mucosal Epithelial Cells. J Cell Biol148, 1305-1315 (2000).
Louis et al. 'Diversity, metabolism and microbial ecology of butyrate-producing bacteria from the human large Intestine.' FEMS Microbiology Letters. 2009, vol. 294, No. 1, pp. 1-8.
Louis et al. 'Diversity of human colonic butyrate-producing bacteria revealed by analysis of the butyryl-GoA: acetate GoA-transferase gene.' Environmental Microbiology. 2010, vol. 12, No. 2, pp. 304-314.
Louis et al. 'Organization of butyrate synthetic genes in human colonic bacteria: phylogenetic conservation and horizontal gene transfer.' FEMS Microbiology Letters. 2007, vol. 269, No. 2, pp. 240-247.
Lovell, Mark A., et al., Oxidative DNA damage in mild cognitive impairment and late-stage Alzheimer's disease, Nucleic Acids Research, 2007, vol. 35, No. 22, pp. 7497-7504 doi:10.1093/nar/gkm821.
Lozupone. Diversity, stability and resilience of the human gut microbiota. 2012. Nature. Sep. 13, 2012; 489 (7415): 220-230.
López, P., González-Rodríguez, I., Gueimonde, M., Margolles, A., and Suárez, A. (2011). Immune Response to Bifidobacterium bifidum Strains Support Treg/Th17 Plasticity. Plos One 6(9), e24776. doi: 10.1371/journal.pone.0024776.
López, P., Gueimonde, M., Margolles, A., and Suárez, A. (2010). Distinct Bifidobacterium strains drive different immune responses in vitro. International Journal of Food Microbiology 138(1), 157-165. doi: https://doi.org/10.1016/j.ijfoodmicro.2009.12.023.
Ludolph, A C et al. "Tauopathies with parkinsonism: clinical spectrum, neuropathologic basis, biological markers, and treatment options." European journal of neurology vol. 16,3 (2009): 297-309. doi: 10.1111/j.1468-1331.2008.02513.x.
Luger, D. and Caspi, R.R., New perspectives on effector mechanisms in uveitis. (2008) Semin. Immunopathol. 30(2): 134-143.
Álvarez-Martín, P., O'Connell-Motherway, M., van Sinderen, D., and Mayo, B. (2007). Functional analysis of the pBC1 replicon from Bifidobacterium catenulatum L48. Applied Microbiology and Biotechnology 76(6), 1395. doi: 10.1007/s00253-007-1115-5.
Lyons, et al., Bacterial strain-specific induction of Foxp3 T regulatory cells is protective in murine allergy models. Clinical & Experimental Allergy. 2010; 40:811-819.
Machiels, et al., Predominant dysbiosis in patients with ulcerative colitis is different from Crohn's disease patients, Inflammatory Bowel Diseases, Microbiology 2012. 8th Congress of ECCO. (This Abstract is in 7th Congress 2012).
Machiels, K. A decrease of the butyrate-producing species Roseburia hominis and Faecalibacterium prausnitzii defines dysbiosis in patients with ulcerative colitis.Gut. Aug. 2014;63(8):1275-83. doi: 10.1136/gutjnl-2013-304833. Epub Sep. 10, 2013.
MacPherson, AJ. et al., IgA responses in the intestinal mucosa against pathogenic and non-pathogenic microorganisms. Oct. 2001. 3(12). 1021-1035.
MacPherson, AJ., et al., The functions of mucosal T cells in containing the indigenous commensal flora of the intestine.Cell Mol Life Sci. Dec. 2002;59(12):2088-96.
MacPherson et al. 'IgA adaptation to the presence of commensal bacteria in the intestine.' Gut-Associated Lymphoid Tissues. Springer Berlin Heidelberg, 2006. 117-136.
MacSharry et al., Immunomodulatory effects of feeding with bifidobacterium longum on allergen-induced lung inflammation in the mouse. Pulmonary pharmacology & Therapeutics. 2012; 25:325-334.
Maddison, Daniel C. et al., The kynurenine pathway and neurodegenerative disease, Seminars in Cell Dev Bio, 2015, 40, 134.
Mahowald et al. 'Characterizing a model human gut microbiota composed of members of its two dominant bacterial phyla.' Proceedings of the National Academy of Sciences. 2009, vol. 106, No. 14, pp. 5859-5864.
Maintaining Cultures for Biotechnology and Industry (1996) Jennie C. Hunter-Cevera, Academic Press.
Mallya et al. 'Characterization of the five novel Ly-6 superfamily members encoded in the MHC, and detection of cells expressing their potential ligands.' Protein Science. 2006, vol. 15, No. 10, pp. 2244-2256.
Manni et al., A tale of two cytokines: IL-17 and IL-22 in asthma and infection. Expert Rev Respir Med. Feb. 2014 ; 8(1): 25-42. doi:10.1586/17476348.2014.854167.
Mansour et al. Isolation of Enterococcus faecium NM113, Enterococcus faecium NM213 and Lactobacillus casei NM512 as novel probiotics with immunomodulatory properties. (2014) Microbiol Immunol. 58(10):559-69.
Martin et al., Cloning, Nucleotide Sequence, and Taxonomic Implications of the Flagellin Gene of Roseburia cecicola, Journal of Bacteriology. Jun. 1988; 170(6):2612-2617.
Martin R. et al., Isolation of lactobacilli from sow milk and evaluation of their probiotic potential. J of dairy research 76(4)418-425. Nov. 2009.
Masco, L., et al., Identification of Bifidobacterium Species Using rep-PCR Fingerprinting. Systematic and Applied Microbiology 26(4):557-63 • Dec. 2003.
Matsuda F et al.: Evaluation of a probiotics,BBG-01, for enhancement of immunogenicity of an oral inactivated cholera vaccine and safety: A randomized, double-blind, placebo-controlled trial in Bangladeshi children under 5 years of age,Vaccine, Elsevier, Amsterdam, NL, vol. 29, No. 10, Dec. 26, 2010 (Dec. 26, 2010), pp. 1855-1858, XP028147184, ISSN: 0264-410X, DOI: 10.1016/J.VACCINE.2010.12.133 [retrieved on Jan. 7, 2011] *cf. abstract*.
Matthes, et al., Simultaneous rapid chemical synthesis of over one hundred oligonucleotides on a microscale. Apr. 1984. EMBO Journal, 3(4): p. 801-805.
Maya, J.R. et al., Emerging Therapies for Noninfectious Uveitis: What May Be Coming to the Clinics. (2014) J. Ophthalmology. 310329.
Mayer, Emeran A. et al., "Gut Microbes and the Brain: Paradigm Shift in Neuroscience", Journal of Neuroscience Nov. 12, 2014, 34 (46) 15490-15496; DOI: https://doi.org/10.1523/JNEUROSCI.3299-14.2014.
Mazmanian et al. 'An immunomodulatory molecule of symbiotic bacteria directs maturation of the host immune system.' Cell. 2005, vol. 122, No. 1, pp. 107-118.
Mazmanian, SK., An immunomodulatory molecule of symbiotic bacteria directs maturation of the host immune system.Cell. Jul. 15, 2005;122(1):107-18.
McCarville, J.L., Dong, J., Caminero, A., Bermudez-Brito, M., Jury, J., Murray, J.A., et al. (2017). A Commensal Bifidobacterium longum Strain Prevents Gluten-Related Immunopathology in Mice through Expression of a Serine Protease Inhibitor. Applied and Environmental Microbiology 83(19), e01323-01317. doi: 10.1128/AEM.01323-17.

(56) References Cited

OTHER PUBLICATIONS

McClymont, S.A., Putnam Al Fau—Lee, M.R., Lee Mr Fau—Esensten, J.H., Esensten Jh Fau—Liu, W., Liu W Fau—Hulme, M.A., Hulme Ma Fau—Hoffmuller, U., et al. (2011). Plasticity of human regulatory T cells in healthy subjects and patients with type 1 diabetes. Journal of Immunology 186(7), 3918-3926. doi: 10.4049/jimmunol.1003099.

McIntosh et al. 'Mechanism of conjugated linoleic acid and vaccenic acid formation in human faecal suspensions and pure cultures of intestinal bacteria.' Microbiology. 2009, vol. 155, No. 1, pp. 285-294.

McLaughlin., "McLaughlin et al. Fatty acid chain length determines cholecystokinin secretion and effect on human gastric motility. Gastroenterology. 1999, vol. 116, No. 1, pp. 46-53".

Menard, S., Laharie D Fau—Asensio, C., Asensio C Fau—Vidal-Martinez, T., Vidal-Martinez T Fau—Candalh, C., Candalh C Fau—Rullier, A., Rullier A Fau—Zerbib, F., et al. (2005). Bifidobacterium breve and *Streptococcus thermophilus* secretion products enhance T helper 1 immune response and intestinal barrier in mice. Experimental Biology and Medicine (Maywood) 230(10), 749-756.

Meyer et al. (1992) "The use of cassava mosaic virus as a vector system for plants," Gene. 110:213-217.

Meyza, et al. The BTBR mouse model of idiopathic autism—Current view on mechanisms. 2017. Neurosci Biobehav Rev.;76(Pt A):99-110.

Migheli A et al., c-Jun, JNK/SAPK kinases and transcription factor NF-kappa B are selectively activated in astrocytes, but not motor neurons, in amyotrophic lateral sclerosis, J Neuropathol Exp Neurol. Dec. 1997;56(12):1314-22.

Mikayama, et al., Molecular cloning and functional expression of a cDNA encoding glycosylation-inhibiting factor. Proc.Nati.Acad. Sci. USA, Nov. 1993; vol. 90: 10056-1 0060.

Milani, C., Mangifesta, M., Mancabelli, L., Lugli, G.A., Mancino, W., Viappiani, A., et al. (2017). The Sortase-Dependent Fimbriome of the Genus *Bifidobacterium*: Extracellular Structures with Potential To Modulate Microbe-Host Dialogue. Appl Environ Microbiol 83(19). doi: 10.1128/AEM.01295-17.

Mincheol Kim et al., "Towards a taxonomic coherence between average nucleotide identity and 16S rRNA gene sequence similarity for species demarcation of prokaryotes", International Journal of Systematic and Evolutionary Microbiology (2014), 64, 346-351.

Miossec et al., Targeting IL-17 and TH17 cells in chronic inflammation, 2012; Nature Drug Discovery 11, 763-776.

Miossec, P et al. Targeting IL-17 and TH17 cells in chronic inflammation. Nat Rev Drug Discov. Oct. 2012;11 (10):763-76. doi: 10.1038/nrd3794.

Miraglia Del Giudice, M., Indolfi, C., Capasso, M., Maiello, N., Decimo, F., and Ciprandi, G. (2017). Bifidobacterium mixture (B longum BB536, B infantis M-63, B breve M-16V) treatment in children with seasonal allergic rhinitis and intermittent asthma. Italian Journal of Pediatrics 43(1), 25. doi: 10.1186/s13052-017-0340-5.

Mitropoulou, G. et al. Immobilization Technologies in Probiotic Food Production. (2013) Journal Nutr Metab. (2013) 716861.

Miwa, K et al., Interleukin-6, interleukin-6 receptor gene variant, small-vessel disease and incident dementia, European Journal of Neurology, 2016, pp. 656-663.

Miyake, et al., Phylogenetic analysis of the genus *Bifidobacterium* and related genera based on 16S rDNA sequences. Microbiol. Immunol. 1998; 42(10): 661-667.

Miyake, T. et al., Phylogenetic Analysis of the Genus *Bifidobacterium* and Related Genera Based on 16S rDNA Sequences. Microbiol. Immunol. 1998; 42(10):661-667.

Miyamoto-Shinohara et al. Survival of freeze-dried bacteria. J Gen Appl Microbiol 54(1):9-24 (2008).

Miyauchi, E., Control of multiple sclerosis by gut microbiota. Journal of clinical and experimental medicine. 2015. vol. 253 No. 5.2, pp. 445-450.

Molecular Biology Techniques, 1st edition. An intensive laboratory course. 1998.

Monteleone et al., IL-10-dependent partial refractoriness to Toll-like receptor stimulation modulates gut mucosal dendritic cell function, European Journal of Immunology. 2008; 38(6): 1533-1547.

Monteleone, I. et al., Th17-related cytokines: new players in the control of chronic intestinal inflammation. (2011) BMC Medicine. 2011, 9:122.

Mortaz, E. et, al., Anti-Inflammatory Effects of Lactobacillus Rahmosus and Bifidobacterium Breve on Cigarette Smoke Activated Human Mcrophiages, PLoS ONE, Apr. 21, 20i15, 10(8):e0136455.DOI:10.1371, Journal.pone.0136455.

Mothapo, K.M., Amyloid beta-42 (Aβ-42), neprilysin and cytokine levels. A pilot study in patients with HIV related cognitive impairments, Amyloid beta-42 (Aβ-42), neprilysin and cytokine levels. A pilot study in patients with HIV related cognitive impairments, Journal of Neuroimmunology, vol. 282, May 15, 2015, pp. 73-79.

Mucientes, A. et al., Specific association of IL17A genetic variants with panuveitis. (2015) Br J Ophthalmol. 99(4):566-70.

Mukai et al., SH3BP2 Gain-Of-Function Mutation Exacerbates Inflammation and Bone Loss in a Murine Collagen-Induced Arthritis Model, 2014 PLoS ONE 9(8): e105518.

Mulder et al. 'Environmentally-acquired bacteria influence microbial diversity and natural innate immune responses at gut surfaces'. BMC Biology. 2009, vol. 7, No. 1, p. 79.

Multiple Sclerosis News Today https//multiplesclerosisnewstoday.com/ms-vs-als-how-do-they-differ/.

Murofushi, Y., Villena, J., Morie, K., Kanmani, P., Tohno, M., Shimazu, T., et al. (2015). The toll-like receptor family protein RP105/MD1 complex is involved in the immunoregulatory effect of exopolysaccharides from Lactobacillus plantarum N14. Mol Immunol 64(1), 63-75. doi: 10.1016/j.molimm.2014.10.027.

Narushima, et al., Characterization of the 17 strains of regulatory T cell-inducing human-derived Clostridia. Gut Microbes Mar. 18, 2014; 5:3, 333-339.

Naughton PJ; Grant G. (2005) Modelling of salmonellosis In: Microbial Ecology of the Growing Animal Holzapfel WH, Naughton PJ. (Eds). London, Elsevier, pp. 235-257.

Rostasy, Kevin et al., NFKB activation, TNF-α expression, and apoptosis in the AIDS-Dementia-Complex,Journal Neurovirology, vol. 6, 2000, pp. 537-543.

C. Julius et al., Prion propagation in mice lacking central nervous system NK-KD signalling, Journal of General Virology (2008), 89, 1545-1550.

Lyras, Leonidas et al., Oxidative Damage to Proteins, Lipids, and DNA in Control Brain Regions from patients with Dementia with Lewy Bodies ,Journal of Neurochemistry 2002, pp. 302-312.

Wang, Yu-Chun et al., Mitochondrial Dysfunction and Oxidative Stress Contribute to the Pathogenesis of Spinocerebellar Ataxia Type 12 (SCA12)*, The Journal of Biological Chemistry 286, 21742-21754.

NCBI Reference Sequence: NR_026314.1, Blautia hydrogenotrophica strain S5a36 16S ribosomal RNA gene, partial sequence (Feb. 3, 2015), 3 pages.

Neeser, J.R., et al., Lactobacillus johnsonii Lal shares carbohydrate-binding specificities with several enteropathogenic bacteria (2000). Glycobiology, 10 (II), pp. II93-II99.

Neish, A. S. et al., Prokaryotic Regulation of Epithelial Responses by Inhibition of IκB-α Ubiquitination. Science 289, 1560 (2000).

Neish et al., TLRS in the Gut. II. Flagellin-induced inflammation and antiapoptosis, American Journal of Physiology-Gastrointestinal and Liver Physiology. 2007;292:G462-466.

Nemeth et al. 'Inhibition of *Salmonella*-induced IL-8 synthesis and expression of Hsp70 in enterocyte-like Caco-2 cells after exposure to non-starter lactobacilli'. International Journal of Food Microbiology. 2006, vol. 112, No. 3, pp. 266-274.

Neville, B.A., Functional genomics of motile commensal intestinal bacteria. PhD Thesis. University College Cork. 2013. 281 Pages.

Neville, et al., Characterization of pro-inflammatory flagellin proteins produced by Lactobacillus ruminis and related motile Lactobacilli. PloS one. Jul. 2012;7(7):e40592.

Neyrinck et al. 'Dietary modulation of clostridial cluster XIVa gut bacteria (*Roseburia* spp.) by chitin-glucan fiber improves host

(56) References Cited

OTHER PUBLICATIONS metabolic alterations induced by high-fat diet in mice.' The Journal of Nutritional Biochemistry. 2012, vol. 23, No. 1, pp. 51-59.
Ng et al., Archaeal flagella, bacterial flagella and type IV pili: a comparison of genes and posttranslation modification, Journal of Molecular Microbiology and Biotechnology. 2006;11:167-191.
Nicolau, D.P. Current challenges in the management of the infected patient (20II). Current Opinion in Infectious Diseases, 24 (Suppll), pp. SI-S10.
Non-Final Office Action dated Oct. 8, 2019 for U.S. Appl. No. 16/265,238.
Non-Final Office Action dated Oct. 9, 2019 for U.S. Appl. No. 15/969,543.
Nordqvist, What is motor neuron disease, 2008 Medical News Today https://www.medicalnewstoday.com/articles/164342.php.
Notice of Allowance dated Feb. 3, 2016 for U.S. Appl. No. 14/349,907.
Notice of Allowance dated Mar. 6, 2017 for U.S. Appl. No. 14/249,710.
Notice of Allowance dated Mar. 30, 2011 for U.S. Appl. No. 10/285,224.
Notice of Allowance dated Apr. 25, 2016 for U.S. Appl. No. 14/232,475.
Notice of allowance dated Jun. 16, 2017 for U.S. Appl. No. 14/249,710.
Notice of Allowance dated Aug. 23, 2016 for U.S. Appl. No. 14/232,475.
Notice of allowance dated Sep. 1, 2017 for U.S. Appl. No. 15/357,850.
Notice of allowance dated Sep. 6, 2017 for U.S. Appl. No. 14/249,710.
Notice of Allowance dated Nov. 17, 2016 for U.S. Appl. No. 14/249,710.
Notice of Allowance dated Nov. 22, 2017 for U.S. Appl. No. 15/359,988.
Notice of Allowance dated Nov. 24, 2017 for U.S. Appl. No. 15/070,605.
Notice of Publication dated Dec. 27, 18 for U.S. Appl. No. 16/022,256.
Nuala Moran: 'Microbial wealth', chemistry and industry, 78(6), Jun. 1, 2014, pp. 20-23, XP055252922.
Numasaki, M. et al., IL-17 Enhances the Net Angiogenic Activity and In Vivo Growth of Human Non-Small Cell Lung Cancer in SCID Mice through Promoting CXCR-2-Dependent Angiogenesis. (2005) J. Immunol. 175: 6177-6189.
Numasaki, M. et al., Interleukin-17 promotes angiogenesis and tumor growth. Blood. Apr. 1, 2003;101(7):2620-7. Epub Oct. 31, 2002.
Nutsch et al., T cell tolerance and immunity to commensal bacteria. Current Opinion in Immunology. Aug. 2012; 24 (4):385-391.
O'Connell Motherway, M., Kinsella, M., Fitzgerald, G.F., and Sinderen, D. (2013). Transcriptional and functional characterization of genetic elements involved in galacto-oligosaccharide utilization by Bifidobacterium breve UCC2003. Microbial biotechnology 6(1), 67-79. doi: 10.1111/1751-7915.12011.
O'Connell Motherway, M., O'Driscoll, J., Fitzgerald Gerald, F., and Van Sinderen, D. (2009). Overcoming the restriction barrier to plasmid transformation and targeted mutagenesis in Bifidobacterium breve UCC2003. Microbial Biotechnology 2(3), 321-332. doi: 10.1111/j.1751-7915.2008.00071.x.
O'Connell Motherway, M., Zomer, A., Leahy, S.C., Reunanen, J., Bottacini, F., Claesson, M.J., et al. (2011). Functional genome analysis of Bifidobacterium breve UCC2003 reveals type IVb tight adherence (Tad) pili as an essential and conserved host-colonization factor. Proc Natl Acad Sci U S A 108(27), 11217-11222. doi: 10.1073/pnas.1105380108.
Odamaki, Toshitaka et al., "Age-related changes in gut microbiota composition from newborn to centenarian: a cross-sectional study," BMC Microbiology (2016) 16:90, pp. 1-12, DOI 10.1186/S12866-016-0708-5.
Odile Menard et al., "Gnotobiotic Mouse Immune Response Induced by *Bifidobacterium* sp. Strains Isolated from Infants", Applied and Environmental Microbiology, Feb. 2008, p. 660-666.

Office Action dated Jan. 2, 2018 for U.S. Appl. No. 15/357,936.
Office Action dated Jan. 11, 2005 for U.S. Appl. No. 10/285,224.
Office Action dated Jan. 26, 2009 for U.S. Appl. No. 10/275,706.
Office Action dated Feb. 18, 2010 for U.S. Appl. No. 10/285,224.
Office Action dated Mar. 13, 2013 for U.S. Appl. No. 12/760,926.
Office Action dated Mar. 26, 2007 for U.S. Appl. No. 10/275,706.
Office Action dated Apr. 4, 2008 for U.S. Appl. No. 10/285,224.
Office Action dated May 2, 2007 for U.S. Appl. No. 10/285,224.
Office Action dated May 2, 2008 for U.S. Appl. No. 10/275,706.
Office Action dated May 25, 2016 for U.S. Appl. No. 14/249,710.
Office Action dated May 26, 2009 for U.S. Appl. No. 10/285,224.
Office Action dated May 26, 2017 for U.S. Appl. No. 15/357,850.
Office Action dated May 30, 2006 for U.S. Appl. No. 10/285,224.
Office Action dated Jun. 26, 2017 for U.S. Appl. No. 15/357,936.
Office Action dated Jul. 6, 2017 for U.S. Appl. No. 15/070,605.
Office action dated Jul. 8, 2015 for U.S. Appl. No. 14/349,907.
Office Action dated Jul. 31, 2017 for U.S. Appl. No. 15/359,988.
Office Action dated Aug. 10, 2017 for U.S. Appl. No. 15/357,850.
Office Action dated Aug. 21, 2013 for U.S. Appl. No. 12/760,926.
Office Action dated Sep. 4, 2015 for U.S. Appl. No. 14/249,710.
Office Action dated Sep. 17, 2010 for U.S. Appl. No. 10/285,224.
Office Action dated Oct. 12, 2005 for U.S. Appl. No. 10/285,224.
Office Action dated Oct. 28, 2009 for U.S. Appl. No. 10/275,706.
Office Action dated Oct. 30, 2008 for U.S. Appl. No. 10/285,224.
Office Action dated Nov. 2, 2017 for U.S. Appl. No. 15/700,007.
Office Action dated Nov. 6, 2006 for U.S. Appl. No. 10/285,224.
Office Action dated Nov. 23, 2015 for U.S. Appl. No. 14/232,475.
Office Action dated Nov. 24, 2017 for U.S. Appl. No. 15/359,972.
Office Action dated Nov. 24, 2017 for U.S. Appl. No. 15/679,857.
Office Action dated Dec. 6, 2017 for U.S. Appl. No. 15/592,178.
Office Action dated Dec. 13, 2012 for U.S. Appl. No. 12/760,926.
Office Action dated Dec. 19, 2005 for U.S. Appl. No. 10/275,706.
Office Action dated Mar. 19, 2019 for U.S. Appl. No. 16/031,024.
Ohashi, Y., Ushida, K. Health-beneficial effects ofprobiotics: Its mode of action (2009). Animal Science Journal, 80 (4), pp. 361-371.
Ohta, Y., Tremblay, et al. Interaction of transactive response DNA binding protein 43 with nuclear factor κB in mild cognitive impairment with episodic memory deficits. acta neuropathol commun 2, 37 (2014). https://doi.org/10.1186/2051-5960-2-37.
Oladipo, et al., Bioprotective potential of bacteriocinogenic enterococcus gallinarum strains isolated from some Nigerian fermented foods, and of their bacteriocins. Polish Journal of Microbiology. 2014; 63(4): 415-422.
Olivares, M., Castillejo, G., Varea, V., and Sanz, Y. (2014). Double-blind, randomised, placebo-controlled intervention trial to evaluate the effects of Bifidobacterium longum CECT 7347 in children with newly diagnosed coeliac disease. British Journal of Nutrition 112(1), 30-40. doi: 10.1017/S0007114514000609.
Olivera et al. 'Nutritional and physiological responses of young growing rats to diets containing raw cowpea seed meal, protein isolate (globulins), or starch.' Journal of agricultural and food chemistry. 2003, vol. 51, No. 1, pp. 319-325.
O'Sullivan et al., "Bacterial Supplementation in the Irritable Bowel Syndrome. A Randomised Double-Blind Placebo-Controlled Crossover Study", Digest Liver Dis. 2000. pp. 294-301.
Overbeek, R., Begley, T., Butler, R.M., Choudhuri, J.V., Chuang, H.-Y., Cohoon, M., et al. (2005). The Subsystems Approach to Genome Annotation and its Use in the Project to Annotate 1000 Genomes. Nucleic Acids Research 33(17), 5691-5702. doi: 10.1093/nar/gki866.
Overstreet et al. 'Dysbiosis Characterized by Reduced Abundance of Roseburia is Associated With Increased Severity of Colitis in IL-10-/- Mice'. Gastroenterology. 2011, vol. 140, No. 5, Suppl. 1, pp. S-696.
Pace et al. Macrophage activiation: Priming activity from a T-cell hybridoma is attributable to interferon. (1983) PNAS. 80:3782-6.
Pal Rishi et al., "Role of neuroinflammation and latent transcription factors in pathogenesis of Parkinson's disease", Neurological Research, 2016, 38(12), 1111-1122.
Palluzzi, Fernando et al., A novel network analysis approach reveals DNA damanage, oxidative stress and calcium/cAMP homeostasis-associated biomarkers in frontotemporal dementia, Plos One, Oct. 11, 2017, pp. 1-27, https://doi.org/10.1371/journal.pone.0185797.

(56) References Cited

OTHER PUBLICATIONS

Pang, et al., Crystal structure of human pirin: an iron-binding nuclear protein and transcription cofactor. Journal of Biological Chemistry, 279(2); Jan. 9, 2004:1491-1498.
Parabacteroides distasonis (Eggerth and Gagnon) Sakamoto and Benno (ATCC 8503). Sep. 19, 2017. 2 Pages.
Parfenov A.I., "Pain syndrome in the practice of a gastroenterologist", RMJ Breast Cancer, 2008; 0: 32.
Park, S.K. et al., *Blautia stercoris* sp. nov., isolated from human faeces. International journal of systematic and evolutionary microbiology. 2012; 62(4): 776-779.
Patel., R. et al., Determination of 16S rRNA sequences of enterococci and application to species identification of nonmotile enterococcus gallinarum isolates. Journal of clinical microbiology, 1998; 36(11):3399-3407.
Patin, Franick et al., Combined Metabolomics and Transcriptomics Approaches to Asses the IL-6 Blockade as a Therapeutic of ALS: Deleterious Alteration of Lipid Metabolism, Neurotherapeutics (2016) 13:905-91.
Paustian, C., Taylor, P., Johnson, T., Xu, M., Ramirez, N., Rosenthal, K.S., et al. (2013). Extracellular ATP and Toll-like receptor 2 agonists trigger in human monocytes an activation program that favors T helper 17. PLoS One 8(1), e54804. doi: 10.1371/journal.pone.0054804.
PCR (Introduction to Biotechniques Series), 2nd ed. (Newton & Graham eds., 1997, Springer Verlag).
PCT/EP2017/025038 International Preliminary Report on Patentability dated Jun. 6, 2018, 8 Pages.
PCT/EP2017/025038 International Search Report and Written Report dated Jun. 12, 2017.
PCT/EP2017/025038 Written Opinion of the International Preliminary Examining Authority dated Jan. 1, 2018.
PCT/EP2017/025038 Written Opinion of the International Preliminary Examining Authority dated Jan. 25, 2018.
PCT/GB2017/052076 Written Opinion of the International Preliminary Examining Authority dated Jun. 21, 2018, 11 Pages.
PCT/GB2017/052077 International Search Report dated Oct. 16, 2017.
PCT/GB2017/052077 Written Opinion dated Oct. 16, 2017.
PCT/GB2017/052077 Written Opinion of the International Preliminary Examining Authority dated Jun. 21, 2018, 10 Pages.
Pearson, WR. An introduction to sequence similarity ("Homology") searching. Current protocols in bioinformatics/editoral board, Andreas D Baxevanis. [et al], 2013; 0 3:10. 1002/0471250953.bi0301s42. doi:10.1002/0471250953.bi0301s42.
Pedro Berraondo et al., "Cytokines in clinical cancer immunotherapy", British Journal of Cancer, 2019, 120:6-15.
Petersen et al. Intestinal colonization with phylogenetic group B2 *Escherichia coli* related to inflammatory bowel disease: a systematic review and meta-analysis. 2015. Scand J Gastroenterol.;50(10):1199-207.
Peterson et al. 'Catecholamines increase conjugative gene transfer between enteric bacteria.' Microbial Pathogensis. 2011, vol. 51, No. 1, pp. 1-8.
Petsuriyawong et al. 'Screening of probiotic lactic acid bacteria from piglet feces'. Nature Science. 2011, vol. 45, pp. 245-253.
Ping Dong et al., "The role of intestinal bifidobacteria on immune system development in young rats", Early Human Development 86 (2010) 51-58.
Pinto-Sánchez, M.I., Smecuol, E.C., Temprano, M.P., Sugai, E., González, A., Moreno, M.L., et al. (2017). Bifidobacterium infantis NLS Super Strain Reduces the Expression of α-Defensin-5, a Marker of Innate Immunity, in the Mucosa of Active Celiac Disease Patients. Journal of Clinical Gastroenterology 51(9), 814-817. doi: 10.1097/mcg.0000000000000687.
Pirooznia, Sheila K, and Felice Elefant. "Targeting specific HATs for neurodegenerative disease treatment: translating basic biology to therapeutic possibilities." Frontiers in cellular neuroscience vol. 7 30. Mar. 28, 2013, doi:10.3389/fncel.2013.00030.
Pizzimenti, Stefania et al. "The "two-faced" effects of reactive oxygen species and the lipid peroxidation product 4-hydroxynonenal in the hallmarks of cancer." Cancers vol. 2,2 338-63. Mar. 30, 2010, doi:10.3390/cancers2020338.
Polak J.M. and McGee J.O., In Situ Hybridization: Principles and Practice, Oxford University Press. 1990; pp. vii-viii.
Potrykus (1991) "Gene Transfer to Plants: Assessment of Published Approaches and Results," Annu. Rev. Plant Physiol. Plant Mol. Bioi. 42:205-225.
Prakash, et al., Complete genome sequences of rat and mouse segmented filamentous bacteria, a potent inducer of th17 cell differentiation. Cell Host & Microbe. Sep. 2011;10(3):273-284.
Pryde et al. 'The microbiology of butyrate formation in the human colon.' FEMS Microbiology Letters. 2002. vol. 217,No. 2, pp. 133-139.
Psaty BM et al., "Health outcomes associated with various antihypertensive therapies used as first-line agents: a network meta-analysis.",JAMA. May 21, 2003;289(19):2534-44.
Punt et al. (2002) "Filamentous fungi as cell factories for heterologous protein production," Trends Biotechnol. 20 (5):200-206.
Qin et al. 'A human gut microbial gene catalogue established by metagenomic sequencing.' Nature. 2010, vol. 464, No. 7285, pp. 59-65.
Radford, RA, et al., The established and emerging roles of astrocytes and microglia in amyotrophic lateral sclerosis and frontotemporal dementia, Front Cell Neurosci, Oct. 27, 2015; 9:414.
Rajilic-Stojanovic, et al. The first 1000 cultures species of the human gastrointestinal micriobiota. FEMS Mlcriobiol Rev, vol. 38, 2014. pp. 996-1047.
Reddy, K.B.P.K., et al., Role of cryoprotectants on the viability and functional properties of pro biotic lactic acid bacteria during freeze drying (2009). Food Biotechnology, 23 (3), pp. 243-265.
Reiff,C. and Kelly,D.,Inflammatory bowel disease, gut bacteria and probiotic therapy. International journal of medical microbiology, 2010;300:25-33.
Reuter, G. (2001). The Lactobacillus and Bifidobacterium microflora of the human intestine: composition and succession. Current Issues in Intestinal Microbiology 2(2), 43-53.
Rhee et al.,Toll-Like Receptor 5 Engagement Modulates Tumor Development and Growth in a Mouse Xenograft Model of Human Colon Cancer. Gastroenterology. Aug. 2008;135(2):518-528.
Rhee, Young-Kyung et al.., Antihumor Activity of *Bifidobacterium* Spp. isolated from a healthy Korean, Arch Pharm Res vol. 23, No. t, 482-487 2000.
Riquelme. Will 4D Pharma be UK's next Microbiome leader? Feb. 2, 2015, LABIOTECH.eu [online].
Robertson, J.M.C., et al., Lack of flagella disadvantages *Salmonella enterica* serovar Enteritidis during the early stages of infection in the rat (2003). Journal of Medical Microbiology, 52 (1), pp. 91-99.
Robinson, et al. Inside information—The unique features of visceral sensation. 2008. Mol Interv, 8(5): 242-253.
Rockwell, S.C. et al., Characteristics of a Serially Transplanted Mouse Mammary Tumor and Its Tissue-Culture-Adapted Derivative. (1972) J Natl Cancer Inst. 49:735-49.
Roe, et al., DNA Isolation and Sequencing: Essential Techniques. John Wiley & Sons, New York, New York. 1996; pp. v-vii.
Rong, Y., Dong, Z., Hong, Z., Jin, Y., Zhang, W., Zhang, B., et al. (2017). Reactivity toward Bifidobacterium longum and Enterococcus hirae demonstrate robust CD8(+) T cell response and better prognosis in HBV-related hepatocellular carcinoma. Experimental Cell Research 358(2), 352-359. doi: 10.1016/j.yexcr.2017.07.009.
Roseburia. Ubiome, 2018. Accessed on Jun. 25, 2018; Available at: https://shop.ubiome.com/pages/roseburia-1.
Rosse, Gerard, HDAC Inhibitors as Targeted Treatment of Frontotemporal Lobar Degeneration, ACS Medicinal Chemistry Letters, ACS Publications, Published Nov. 30, 2012.
Round et al. 'The Toll-like receptor 2 pathway establishes colonization by a commensal of the human microbiota.' Science. 2011, vol. 332, No. 6032, pp. 974-977.
Rudinger J, "Characteristics of the amino acids as components of a peptide hormone sequence," Peptide Hormones, JA Parsons Edition, University Park Press, Jun. 1976, pp. 1-7.

(56) References Cited

OTHER PUBLICATIONS

Ruiz, L., Delgado, S., Ruas-Madiedo, P., Margolles, A., and Sanchez, B. (2016). Proteinaceous Molecules Mediating Bifidobacterium-Host Interactions. Front Microbiol 7, 1193. doi: 10.3389/fmicb.2016.01193.

Ruiz, P.A., Hoffmann, M., Szcesny, S., Blaut, M., and Haller, D. (2005). Innate mechanisms for Bifidobacterium lactis to activate transient pro-inflammatory host responses in intestinal epithelial cells after the colonization of germ-free rats. Immunology 115(4), 441-450. doi: 10.1111/j.1365-2567.2005.02176.x.

Russell et al. 'High-protein, reduced-carbohydrate weight-loss diets promote metabolite profiles likely to be detrimental to colonic health.' The American Journal of Clinical Nutrition. 2011, vol. 93, No. 5, pp. 1062-1072.

Sagar, et al., Bifidobacterium breve and lactobacillus rhamnosus treatment is as effective as budesonide at reducing inflammation in a murine model for chronic asthma. Respiratory Research. 2014; 15(46):1-17.

Saggu, Raman et al., Astroglial NF-kB contributes to white matter damage and cognitive impairment in a mouse model of vascular dementia, 2016 Acta Neuropathol Commun 4(1) 76.

Saiki, et al., Primer-directed enzymatic amplification of DNA with a thermostable DNA polymerase. 1988. Science, 239. pp. 487-491.

Saiyed et al., HIV-1 Tat Upregulates Expression of Histone Deacetylase-2 (HDAC2) in Human Neurons: Implication for HIV-Associated Neurocognitive Disorder (HAND), 2011 Neurochem Int 58(6) 656-664.

Sakamato, et al., *Parabacteroides faecis* sp. nov., isolated from human faeces. International Journal of Systematic and Evolutionary Microbiology (2015), 65, 1342-1346.

Sakamoto, et al., *Parabacteroides gordonii* sp. nov., isolated from human blood cultures. International Journal of Systematic and Evolutionary Microbiology (2009), 59, 2843-2847.

Sakamoto, et al., *Parabacteroides johnsonii* sp. nov., isolated from human faeces. International Journal of Systematic and Evolutionary Microbiology (2007), 57, 293-296.

Sakamoto, M. et al., Reclassification of Bacteroides distasonis, Bacteroides goldsteinii and Bacteroides merdae as *Parabacteroides distasonis* gen. nov., comb, nov., *Parabacteroides goldsteinii* comb. nov. and *Parabacteroides merdae* comb. nov. International journal of systematic and evolutionary microbiology. 2006; 56: 1599-1605.

Sakamoto Mitsuo et al., Reclassfication of Baceroides distasonis, Bacteroides goldsteinii and Bacteroides merdae as *Parabacteroides distasonis* gen. nov., comb, nov., *Parabacteroides goldsteinii* comb. nov. and *Parabacteroides merdae* comb, nov., International Journal of Systematic and Evolutionary Microbiology (2006) 56, 15-99-1605. DOI 10.1099/ijs.0.0641920.

Salix Pharmaceuticals, Inc. FDA Highlights of Prescribing Information—XIFAXAN (rifaximin tablet). Revised Nov. 2015.

Salminen et al. 'Probiotics: how should they be defined?.' Trends in Food Science & Technology. 1999, vol. 10, No. 3, pp. 107-110.

Salonen et al., Gastrointestinal microbia in irritable bowel syndrome: present state and perspectives. Microbiology. 2010; 156: 3205-3215.

Scanlan PD., et al., Culture-independent analyses of temporal variation of the dominant fecal microbiota and targeted bacterial subgroups in Crohn's disease. J Clin Microbiol. Nov. 2006;44(11):3980-8. Epub Sep. 20, 2006.

Scher et al., Expansion of intestinal Prevotella copri correlates with enhanced susceptibility to arthritis. 2013; eLIFE 2, e01202, 20 Pages.

Schiavi, E., Gleinser, M., Molloy, E., Groeger, D., Frei, R., Ferstl, R., et al. (2016). The Surface-Associated Exopolysaccharide of Bifidobacterium longum 35624 Plays an Essential Role in Dampening Host Proinflammatory Responses and Repressing Local TH17 Responses. Appl Environ Microbiol 82(24), 7185-7196. doi: 10.1128/AEM.02238-16.

Schiavi, E., Plattner, S., Rodriguez-Perez, N., Barcik, W., Frei, R., Ferstl, R., et al. (2018). Exopolysaccharide from *Bifidobacterium longum* subsp. *longum* 35624 modulates murine allergic airway responses. Benef Microbes, 1-14. doi: 10.3920/BM2017.0180.

Schieck, M. et al., Genetic variation in TH17 pathway genes, childhood asthma, and total serum IgE levels.(2014) J Allergy Clin Immunol. 133(3):888-91.

Schleifer, K.H. et al., Transfer of *Streptococcus faecalis* and *Streptococcus faecium* to the Genus *Enterococcus* nom. rev. as *Enterococcus faecalis* comb. nov. and *Enterococcus faecium* comb. nov. Int J Syst Evol Microbiol, Jan. 1984 34: 31-34, doi:10.1099/00207713-34-1-31.

Schmitz, S. et al., A prospective, randomized, blinded, placebo-controlled pilot study on the effect of Enterococcus faecium on clinical activity and intestinal gene expression in canine food-responsive chronic enteropathy. J Vet Intern Med. Mar.-Apr. 2015;29(2):533-43. doi: 10.1111/jvim.12563. Epub Mar. 16, 2015.

Schouten, et al., Cow milk allergy symptoms are reduced in mice fed dietary synbiotics during oral sensitization with whey. Nutritional Immunology. 2015; 139(7):1390-403.

Schreiber, O, et al., Lactobacillus reuteri prevents colitis by reducing P-selectin-associated leukocyte- and plateletendothelial cell interactions (2009). American Journal of Physiology-Gastrointestinal and Liver Physiology, 296 (3), pp. G534-G542.

Schrek, Ralf et al.,Reactive oxygen intermediates as apparently widely used messengers in the activation of the NF-xB transcription factor and HIV-1, The EMBO Journal 10 8 224.

Schulke et al. (Aug. 26, 2011) "A fusion protein of ftagellin and ovalbumin suppresses the 25 TH2 response and prevents murine intestinal allergy," The Journal of Allergy and Clinical Immunology. 128(6):1340-1348.

Schwiertz, et al., Quantification of Different *Eubacterium* spp. in Human Fecal Samples with Species-Specific 16S rRNA-Targeted Oligonucleotide Probes. Applied and environmental biology, vol. 66, No. 1, Jan. 1, 2000; pp. 375-382.

Scott et al. 'Substrate-driven gene expression in Roseburia inulinivorans: importance of inducible enzymes in the utilization of inulin and starch.' Proceedings of the National Academy of Sciences. 2011, vol. 108, Supp. 1, pp. 672-4679.

Scuotto, Angelo et al., In silico mining and characterization of bifidobacterial lipoprotein with CHHP domain secreted in an aggregated form, International J. of Biol. Macromolecutes 82(2016), 653-662.

Sczesnak, et al., The genome of th17 cell-inducing segmented filamentous bacteria reveals extensive auxotrophy and adaptations to the intestinal environment. Cell Host Microbe. Sep. 2011;10 (3):260-272.

Sekizawa, Tsuyoshi et al., Cerebrospinal fluid interleukin 6 in amyotrophic lateral sclerosis: immunological parameter and comparison with inflammatory and non-inflammatory central nervous system diseases, Journal of Neurological Sciences 154 (1998) 194.

Seo, Jae-Suk et al., SIRT1, a histone deacetylase, regulates prion protein-induced neuronal cell death,Neurobiology of Aging 33 (2012) 1110-1120.

Severijnen, A. J. et al., Chronic Arthritis Induced in Rats by Cell Wall Fragments of *Eubacterium* Species from the Human Intestinal Flora. Infection and Immunity, 1990, vol. 58, No. 2, 523-528.

Severijnen, et al., Chronic Arthritis Induced in Rats by Cell Wall Fragments of *Eubacterium* Species from the Human Intestinal Flora. Infection and Immunity, Feb. 1990; 58(2): p. 523-528.

Sgadari, C. et al., Interferon-inducible protein-10 identified as a mediator of tumor necrosis in vivo. (1996) PNAS. 93:13791-6.

Sgadari et al. Mig, the Monokine Induced By Interferon-g, Promotes Tumor Necrosis In Vivo. (1997) Blood. 89:2635-43.

Shabgah, A.G. et al., Interleukin-17 in human inflammatory diseases. Postepy Dermatol Alergol. Aug. 2014; 31(4): 256-261.

Sharma, S., Taliyan, R. & Ramagiri, S. Histone Deacetylase Inhibitor, Trichostatin A, Improves Learning and Memory in High-Fat Diet-Induced Cognitive Deficits in Mice. J Mol Neurosci 56,1-11 (2015). https://doi.org/10.1007/s12031-014-0461-x.

Shevach et al., Current Protocols in Immunology. John Wiley & Sons. New York, New York. 1992. Table of Contents only, as accessed online at URL: http://www.4ulr.com/products/currentprotocols/immunology_toc.html. [Last Accessed Jun. 18, 2015].

(56) References Cited

OTHER PUBLICATIONS

Silvestroni, Aurelio et al., Distinct neuroinflammatory profile in post-mortem human Huntington's disease, NeuroReport. 20(12):1098-1103, Aug. 5, 2009.
Simon, et al., Peptoids: A modular approach to drug discover, Oct. 1992. PNAS, 89(20):9367-9371.
Simpson-Herren, L. et al., Kinetic parameters and growth curves for experimental tumor systems. Cancer Chemother Rep. Jun. 1970;54(3):143-74.
Sisson, G. et al., Randomised clinical trial: a liquid multi-strain probiotic vs. placebo in the irritable bowel syndrome—a 12 week double-blind study. Aliment Pharmacol Ther. 2014; 40: 51-62.
Sivan, A., Corrales, L., Hubert, N., Williams, J.B., Aquino-Michaels, K., Earley, Z.M., et al. (2015). Commensal Bifidobacterium promotes antitumor immunity and facilitates anti-PD-L1 efficacy. Science 350(6264), 1084-1089. doi: 10.1126/science.aac4255.
Sivieri, K. et al., Probiotic enterococcus faecium CRL 183 inhibit chemically induced colon cancer in male wistar rats. Eur Food Res Technol. 2008; 228:231-237.
Skolnick, et al. From genes to protein structure and function: novel applications of computational approaches in the genomic era. Trends Biotechnol. Jan. 2000;18(1):34-9. Review.
Skountzou, et al., *Salmonella* flagellins are potent adjuvants for intranasally administered whole inactivated influenza vaccine. Vaccine. May 2010; 28(24):4103-4112.
Smith, C.L., et al., Lactobacillus fermentum BRII and fmcto-oligosaccharide partially reduce jejunal inflammation in a model of intestinal mucositis in rats (2008). Nutrition and Cancer, 60(6), pp. 757-767.
Smith et al. Comparison of Biosequences. Advances in Applied Mathematics. 2:482-489 (1981).
Sokol et al. 'Faecalibacterium prausnitzii is an anti-inflammatory commensal bacterium identified by gut microbiota analysis of Crohn disease patients.' Proceedings of the National Academy of Sciences. 2008, vol. 105, No. 43, pp. 6731-16736.
Sokol et al. 'Low counts of Faecalibacterium prausnitzii in colitis microbiota.' Inflammatory bowel diseases. 2009, vol. 15, No. 8, pp. 1183-1189.
Song et al., Impact of Schistosoma japonicum Infection on Collagen-Induced Arthritis in DBA/1 Mice: A Murine Model of Human Rheumatoid Arthritis. 2011; PLoS ONE 6, e23453, 10 pages.
Song, Yuli et al., *Bacteroides goldsteinii* sp. nov. Isolated from Clinical Specimens of Human Intestinal Origin, J. Clinical Microbiology, Sep. 2005, p. 4522-4527. DOI:10.1128/JCM.43.9.4522-4527.2005.
Sonnenburg, et al., Genomic and Metabolic Studies of the Impact of Probiotics on a Model Gut Symbiont and Host. PLoS Biol 4(12): e413. https://doi.org/10.1371/journal.pbio.0040413.
Spor, A. et al., Unravelling the effects of the environment and host genotype on the gut microbiome. Nat Rev Microbiol. Apr. 2011;9(4):279-90. doi: 10.1038/nrmicro2540.
Srutkova, D. et al., Efficiency of PCR-based methods in discriminating *Bifidobacterium longum* ssp. *longum* and *Bifidobacterium longum* ssp. infantis strains of human origin.J Microbiol Methods. Oct. 2011;87(1):10-6. doi: 10.1016/j.mimet.2011.06.014. Epub Jul. 2, 2011.
Stanton et al. (1983) "*Roseburia cecicola* gen. nov., sp. nov., a Motile, Obligately Anaerobic Bacterium from a Mouse Cecum," Int. J. Syst. Bacterial. 33:618-627.
Stokholm, et al., Maturation of the gut microbiome and risk of asthma in childhood. Nature Communications, 2018; 9(141): 1-10.
Stoll et al., Altered microbiota associated with abnormal humoral immune responses to commensal organisms in enthesitis-related arthritis, 2014; Arthritis Res Ther. 16:486.
Stone, Trevor W, Kynurenines in the CNS: from endogenous obscurity to therapeutic importance, Progress in Neurobiology 64 (2001) 185.

Strasser, S. et al., Influence of lyophilization, fluidized bed drying, addition of protectants, and storage on the viability oflactic acid bacteria (2009). Journal of Applied Microbiology, 107(1), pp. 167-177.
Strickertsson, J.A. et al., Enterococcus faecalis Infection and Reactive Oxygen Species Down-Regulates the miR-17-92 Cluster in Gastric Adenocarcinoma Cell Culture. Genes 2014, 5(3), 726-738.
Strobel, H.J. Basic laboratory culture methods for anaerobic bacteria. Methods Mol Biol. 2009;581:247-61. doi: 10.1007/978-1-60761-214-8_16.
Strus et al. Distinct effects of Lactobacillus plantarum KL30B and *Escherichia coli* 3A1 on the induction and development of acute and chronic inflammation. 2015. Cent Eur J Immunol.40(4):420-30.
Sudha B. Singh and Henry C. Lin, "Hydrogen Sulfide in Physiology and Diseases of the Digestive Tract", Microorganisms 2015, 3, 866-889; doi:10.3390/microorganisms3040866.
Sun, D. et al., The role of Th17-associated cytokines in the pathogenesis of experimental autoimmune uveitis (EAU). (2015) Cytokine. 74(1):76-80.
Sun, et al., Exploring gut microbes in human health and disease: Pushing the envelope. Genes Dis. Dec. 2014; 1(2):132-139.doi:10.1016/j.gendis.2014.08.001.
Sung, You Me et al., Mercaptoacetamide-based class II HDAC inhibitor lower AB levels and improves learning and memory in a mouse model of Alzheimer's disease, 2013 Exp Neurol 239 192-201.
Supplement to: Israel, et al., Severe and difficult-to-treat asthma in adults. N Engl J Med 2017; 377:965-76.
Suzanne L. Topalian et al., "Survival, Durable Tumor Remission, and Long-Term Safety in Patients With Advanced Melanoma Receiving Nivolumab", Journal of Clinical Oncology, vol. 32, No. 10, Apr. 1, 2014, pp. 1-12.
Tahoun, A., Masutani, H., El-Sharkawy, H., Gillespie, T., Honda, R.P., Kuwata, K., et al. (2017). Capsular polysaccharide inhibits adhesion of Bifidobacterium longum 105-A to enterocyte-like Caco-2 cells and phagocytosis by macrophages. Gut Pathog 9, 27. doi: 10.1186/s13099-017-0177-x.
Takahashi-Fujigasaki, J, Historic deacetylase (HDAC) 4 involvement in both Lewy and Marinesco bodies, J Neuropathol Appl Neurobiol 32:562-566.
Takashi Nakamura et al., "Evaluation of the Effects of Dietary Organic Germanium, Ge-132, and Raffinose Supplementation on Caecal Flora in Rats", Bioscience of Microbiota, Food and Health vol. 31 (2), 37-45, 2012.
Tamanai-Shacoori, et al., *Roseburia* spp.: a marker of health?. Future Microbiology Review 12(2), 157-170 (2017).
Tan, Hai-Qin et al., *Parabacteroides chartae* sp. nov., an obligately anaerobic species from wastewater of a paper mill, International Journal of systematic and Evolutionary Microbiology (2012), 62-2613-2617, DOI 10.1099/ijs.0.038000-0.
Tanaka, K. and Watanabe, K., In Vitro tebipenem activity against anaerobic bacteria. Japanese Journal of Chemotherapy. Mar. 2009. vol. 57 S-1.
Tang, Ying et al., "Inhibiting Histone Deacetylase 2 (HDAC2) Promotes Functional Recovery From Stroke" 2017, Journal of the American Heart Association, 6(10), 1-28.
Tang,PhD, Jiaqi et al., "Prenatal Hypoxia Induced Dysfunction in Cerebral Arteries of Offspring Rats" 2017, Journal of the American Heart Association, 6(10), 1-12.
Tap et al. Towards the human intestinal microbiota phylogenetic core. 2009. Environ Microbiol, 11(10):2574-84.
Tatusova, et al., Erratum to BLAST 2 Sequences, a new tool for comparing protein and nucleotide sequences [FEMS Microbiol. 174 (1999) 247-250], FEMS Microbial. Lett. 1999;177(1):187-188.
Tatusova et al. (1999) "BLAST 2 Sequences, a new tool for comparing protein and nucleotide sequences," FEMS Microbial. Lett. 174(2):247-250.
Tatusova et al., BLAST 2 Sequences, a new tool for comparing protein and nucleotidesequences, FEMS Microbiology Letters 174 (1999) 247-250.
Tatusova et al., Erratum to BLAST 2 Sequences, a new tool for comparing protein and nucleotide sequences, FEMS Microbiology Letters 177 (1999) 187-188.

(56) References Cited

OTHER PUBLICATIONS

Teng, L. J. et al., PCR Assay for Species-Specific Identification of Bacteroides thetaiotaomicron. J Clin Microbiol38, 1672-1675 (2000).
Terciz, Janos et al., Inflammation and Colon Cancer, Gastroenterology, 2010: 138: 2101-2114.
Tesmer, LA. et al., Th17 cells in human disease. Immunol Rev. 2008;223:87-113.
Tilg, et al., Roseburia hominis: a novel guilty player in ulcerative colitis pathogenesis? Gut, Oct. 14, 2013;63(8)1204-1205.
Tönnies, Eric and Trushina, Eugenia. 'Oxidative Stress, Synaptic Dysfunction, and Alzheimer's Disease'. Journal of Alzheimer's Disease, vol. 57, No. 4, Jan. 1, 2017 : 1105-1121.
Tomas, M.S.J., et al., Stability of freeze-dried vaginal Lactobacillus strains in the presence of different lyoprotectors (2009). Canadian Journal of Microbiology, 55 (5), pp. 544-552.
Tomosada, Y., Villena, J., Murata, K., Chiba, E., Shimazu, T., Aso, H., et al. (2013). Immunoregulatory Effect of Bifidobacteria Strains in Porcine Intestinal Epithelial Cells through Modulation of Ubiquitin-Editing Enzyme A20 Expression. Plos One 8(3), e59259. doi: 10.1371/journal.pone.0059259.
Toomer, O. et al., Maternal and postnatal dietary probiotic supplementation enhances splenic regulatory T helper cell population and reduces peanut allergen-induced hypersensitivity responses in mice. Immunobiology. 209; 2014: 661-670.
Travis, et al. Complete genome sequence of the human gut symbiont Roseburia hominis. Genome announcements. 2015; 3(6):e01286-15.
Tremaroli, et al., A role for the gut microbiota in energy harvesting? Gut. Dec. 2010; 59(12):1589-1590.
Trueman (1995) "Heterologous Expression in Yeast," Methods Molecular Biology. 49:341-354.
Tsukinowa, et al., Fecal microbiota of a dugong (Dugong dugong) in captivity at Toba Aquarium. J. Gen. Appl. Microbiol., 54, 25-38 (2008).
Turchan, J., et al., Oxidative stress in HIV demented patients and protection ex vivo with novel antioxidants,Neurology, Jan. 2003, 60 (2), 307-314.
Turnbaugh et al. A core gut microbiome in obese and lean twins. Jan. 22, 2009. Nature, 457(7228): 480-484.
Turnbaugh, et al., An obesity-associated gut microbiome with increased capacity for energy harvest. Nature. Dec. 2006;444(7122):1027-1031.
Turnbaugh et al., Diet-induced obesity is linked to marked but reversible alterations in the mouse distal gut microbiome. Cell Host & Microbe. Apr. 2008;3(4):213-223.
Turner (1994) "Vectors for genetic manipulation," In; Martinelli, S.D.; Kinghorn J. R.: Eds. Aspergillus: 50 years on. Progress in industrial microbiology. vol. 29. Elsevier. Amsterdam, The Netherlands, pp. 641-666.
Turroni, F., Taverniti V Fau—Ruas-Madiedo, P., Ruas-Madiedo P Fau—Duranti, S., Duranti S Fau—Guglielmetti, S., Guglielmetti S Fau—Lugli, G.A., Lugli Ga Fau—Gioiosa, L., et al. (2014). Bifidobacterium bifidum PRL2010 modulates the host innate immune response. Appl Environ Microbiol 80(1098-5336 (Electronic)), 730-740.
Tzortzis, G., et al., Modulation of anti-pathogenic activity in canine-derived Lactobacillus species by carbohydrate growth substrate (2004). Journal of Applied Microbiology, 96 (3), pp. 552-559.
Udayappan, et al., Oral treatment with Eubacterium hallii improves insulin sensitivity in db/db mice. NPJ Biofilms and microbiomes, vol. 2, Jul. 6, 2016; p. 16009.
Udayappan et al., PS4—5. Administration of Eubacterium hallii improves insulin sensitivity and degree of liversteatosis in male db/db mice. Nederlands tijdschrift voor diabetologie, vol. 11, No. 4., Nov. 23, 2013.pp. 145.
Ukena, et al., Probiotic Escherichia coli Nissle 1917 inhibits leaky gut by enhancing mucosal integrity, PloS one. Dec. 2007;2(12):e1308.
Untergasser, A., Nijveen, H., Rao, X., Bisseling, T., Geurts, R., and Leunissen, J.A. (2007). Primer3Plus, an enhanced web interface to Primer3. Nucleic Acids Res 35(Web Server issue), W71-74. doi: 10.1093/nar/gkm306.
Untergasser, et al., Primer3Plus, an enhanced web interface to Primer3, Nucleic Acids Res. 2007;35(Web Server issue):W71-W74.
U.S. Appl. No. 15/357,936 Notice of Allowance dated Apr. 18, 2018.
U.S. Appl. No. 15/359,144 Notice of Allowance dated Sep. 4, 2018.
U.S. Appl. No. 15/359,972 Notice of Allowance dated Aug. 8, 2018.
U.S. Appl. No. 15/359,988 Notice of Allowance dated Mar. 2, 2018.
U.S. Appl. No. 15/359,988 Notice of Allowance dated Mar. 16, 2018.
U.S. Appl. No. 15/592,178 Notice of Allowance dated Apr. 12, 2018.
U.S. Appl. No. 15/592,178 Notice of Allowance dated Jul. 12, 2018.
U.S. Appl. No. 15/631,945 Notice of Allowance dated Oct. 18, 2018.
U.S. Appl. No. 15/700,007 Notice of Allowance dated Oct. 17, 2018.
U.S. Appl. No. 15/915,885 Notice of Allowance dated May 23, 2018.
U.S. Appl. No. 15/915,889 Notice of Allowance dated Jun. 4, 2018.
U.S. Appl. No. 15/916,167 Notice of Allowance dated May 31, 2018.
U.S. Appl. No. 15/916,202 Notice of Allowance dated Jun. 11, 2018.
U.S. Appl. No. 15/916,205 Notice of Allowance dated May 30, 2018.
U.S. Appl. No. 15/359,144 Office Action dated Apr. 10, 2018.
U.S. Appl. No. 15/359,972 Office Action dated Apr. 4, 2018.
U.S. Appl. No. 15/431,393 Office Action dated Jul. 30, 2018.
U.S. Appl. No. 15/631,945 Office Action dated Jul. 5, 2018.
U.S. Appl. No. 15/631,945 Office Action dated May 15, 2018.
U.S. Appl. No. 15/631,952 Office Action dated Feb. 16, 2018.
U.S. Appl. No. 15/631,952 Office Action dated Jul. 19, 2018.
U.S. Appl. No. 15/673,270 Office Action dated Apr. 10, 2018.
U.S. Appl. No. 15/679,857 Office Action dated Aug. 6, 2018.
U.S. Appl. No. 15/679,857 Office Action dated Feb. 14, 2018.
U.S. Appl. No. 15/700,007 Non-Final Office Action dated Jun. 10, 2019.
U.S. Appl. No. 15/700,007 Office Action dated Jun. 1, 2018.
U.S. Appl. No. 15/704,245 Non-Final Office Action dated Jul. 3, 2019.
U.S. Appl. No. 15/704,245 Office Action dated Sep. 17, 2018.
U.S. Appl. No. 15/803,723 Notice of Allowance dated Feb. 13, 2018.
U.S. Appl. No. 15/842,635 Office Action dated Aug. 27, 2018.
U.S. Appl. No. 15/842,635 Non-Final Office Action dated May 29, 2019.
U.S. Appl. No. 16/022,577 Non-Final Office Action dated Jul. 9, 2019.
Van De Bogert, et al., Immunomodulatory properties of Streptococcus and veillonella isolates from the human small intestine microbiota, PLOS One, Dec. 2014: 1-20, DOI:10.1371/journal.pone. 0114277.
Van de Pol, M.A. et al., Sybiotics reduce allergen-induced T-helper 2 respond and improve peak expiatory flow in allergic asthmatics, Allergy 2011;66:39-47.
Van De Veerdonk, et al., The Anti-CD20 antibody rituximab reduces the Th17 cell response. Arthritis & Rheumatism. Jun. 2011; 63(6):1507-1516.
Van Immerseel et al. 'Butyric acid-producing anaerobic bacteria as a novel probiotic treatment approach for inflammatory bowel disease.' Journal of medical microbiology. 2010, vol. 59, No. 2, pp. 141-143.
Van Nevel et al., "Control of Rumen Methanogenesis." Environmental Monitoring and Assessment, vol. 42, 1996, p. 73097, XP000979267.
Van Tilburg, M. Can we treat visceral hypersensitivity in functional abdominal pain? Lancet Gastroenterolhepatol, 2017; 2 Pages.

(56) References Cited

OTHER PUBLICATIONS

Vécsei, L., Szalárdy, L., Fülöp, F. et al. Kynurenines in the CNS: recent advances and new questions. Nat Rev Drug Discov 12,64-82 (2013). https://doi.org/10.1038/nrd3793.

Verheijden, K.A.T. et al., The development of allergic inflammation in a murine house dust mite asthma is suppressed by symbiotic mixtures of non-digestible oligosaccharides and Bifidobacterium breve M-16V; Eur. J. Nut. (2016) 55: 1141-1151, DOI 10.1007, 500394-015-0928-8.

Vetrovsky, T. and Baldrian, P., The variability of the 16S rRNA gene in bacterial genomes and its consequences for bacterial community analyses. Plos One. Feb. 2013; 8(2): e57923.

Viaud, Sophie et al. "The intestinal microbiota modulates the anticancer immune effects of cyclophosphamide." Science (New York, N.Y.) vol. 342,6161 (2013): 971-6. doi:10.1126/science. 1240537.

Vijay-Kumar, et al., Deletion of TLR5 results in 10 spontaneous colitis in mice. The Journal of Clinical Investigation. Dec. 2007;117(12):3909-3921.

Vijay-Kumar et al., Flagellin Treatment Protects against Chemicals, Bacteria, Viruses, and Radiation. The Journal of Immunology. 2008;180(12):8280-8285.

Waisman Ari et al. 2015, Acta Neuropathologica 129(5), 625-637 http://dx.doi.org/10.1007/s00401-015-1402-7.

Walker et al. 'Dominant and diet-responsive groups of bacteria within the human colonic microbiota.' The ISME Journal. 2010, vol. 5, No. 2, pp. 220-230.

Wang, Chun-Sai-Er, et al., VSL#3 can prevent ulcerative colitis-associated carcinogenesis in mice, Oct. 7, 2018, vol. 24, Issue 37, pp. 4254-4262.

Wang et al. 16S rRNA gene-based analysis of fecal microbiota from preterm infants with and without necrotizing enterocolitis. 2009. ISME J. 3(8): 944-954.

Wang, Feng, Bifidobacterium can mitigate intestinal immunopathology in the context of CTLA-4 blockade, PNA, Jan. 2, 2018 vol. 115, No. 1, pp. 157-161.

Wang, G., Xia, Y., Cui, J., Gu, Z., Song, Y., Q., C.Y., et al. (2014). The Roles of Moonlighting Proteins in Bacteria. Current Issues in Molecular Biology 16, 15-22.

Wang, Huiying et al. "Effect of Probiotics on Central Nervous System Functions in Animals and Humans: A Systematic Review." Journal of neurogastroenterology and motility vol. 22,4 (2016): 589-605. doi:10.5056/jnm16018.

Wang, R.F., and Kushner, S.R. (1991). Construction of versatile low-copy-number vectors for cloning, sequencing and gene expression in *Escherichia coli*. Gene 100, 195-199. doi: https://doi.org/10.1016/0378-1119(91)90366-J.

Wang W., Lyophilization and development of solid protein pharmaceuticals. International J. Pharmaceutics 203: 1-60, 2000.

Wang, Wen-Ying et al., Role of pro-inflammatory cytokines released from microglia in Alzheimer's disease, Ann Transl Med, 2015, 3(10):136.

Wang, Yan, and Lloyd H Kasper. "The role of microbiome in central nervous system disorders." Brain, behavior, and immunity vol. 38 (2014): 1-12. doi:10.1016/j.bbi.2013.12.015.

Watson, et al., Signal transduction in Campylobacter jejuni-induced cytokine production. Cellular Microbiology. 2005;7(5):655-665.

Watt, Nicole T. et al., Reactive Oxygen species-mediated B-Cleavage of the Prion Protein in the Cellular Response to Oxidative Stress, Journal of Biological Chemistry, 2005, 280, 43, 35914.

Wei, X., Yan, X., Chen, X., Yang, Z., Li, H., Zou, D., et al. (2014). Proteomic analysis of the interaction of Bifidobacterium longum NCC2705 with the intestine cells Caco-2 and identification of plasminogen receptors. J Proteomics 108, 89-98. doi: 10.1016/j.jprot.2014.04.038.

Weigel, et al., Comparative analysis of murine marrow-derived dendritic cells generated by Flt3L or GMCSF/IL-4 and matured with immune stimulatory agents on the in vivo induction of antileukemia responses. Blood. Dec. 2002;100(12):4169-4176.

Welman, A.D., and Maddox, I.S. (2003). Exopolysaccharides from lactic acid bacteria: perspectives and challenges. Trends in Biotechnology 21(6), 269-274. doi: https://doi.org/10.1016/S0167-7799(03)00107-0.

Wendler, et al., Identification of a pirin, a novel highly conserved nuclear protein. J. Biol Chem. Mar. 28, 1997; 272(13):8482-9.

Wenzel, S.E., Asthma phenotypes: the evolution from clinical to molecular approaches, Nature medicine, May 2012; 18(5):716-725.

Werth, et al., The transcription factor grainyhead-like 2 regulates the molecular composition of the epithelial apical junctional complex. Development. 2010;37(22):3835-3845.

Westermann, C., Gleinser, M., Corr, S.C., and Riedel, C.U. (2016). A Critical Evaluation of Bifidobacterial Adhesion to the Host Tissue. Front Microbiol 7, 1220. doi: 10.3389/fmicb.2016.01220.

Williams, N.T. Probiotics (2010). American Journal of Health-System Pharmacy, 67 (6), pp. 449-458.

Wilson, et al., The TLR5 ligand flagellin promotes asthma by priming allergic responses to indoor allergens. Nature Medicine. Nov. 2012;18(11):1705-1710.

Winn, Philip et al, A comparison of excitotoxic lesions of the basal forebrain by kainate, quinolinate, ibotenate, N-methyl-D-aspartate or quisqualate, and the effects on toxicity of 2-amino-5-phosphonovaleric acid and kynurenic acid in the rat, Br. J. Pharmacol. (1991), 102, 904-908.

Workman et al. Guidelines for the welfare and use of animals in cancer research (2010) Br. J. Cancer. 102:1555-77.

Written Opinion for PCT/US17/066709 (Published as WO2018112363) owned by Evelo Biosciences, Inc.

Written Opinion for PCT/US2017/066709 (Published as WO2018/112365) owned by Evelo Biosciences, Inc.

Wrzosek, et al., Bacteroides thetaiotaomicron and Faecalibacterium prausnitzii influence the production of mucus glycans and the development of globlet cells in the colonic epithelium of a gnotobiotic model rodent. BMC biology, 2013;11 (61):1-13.

Wunderlich, P.F. et al., Double-blind report on the efficacy of lactic acid-producing enterococcus SF68 in the prevention of antibiotic-associated diarrhoea and in the treatment of acute diarrhoea. The journal of international medical research. 1989; 17: 333-338.

Xie et al. Short communication: Modulation of the small intestinal microbial community composition over short-term or long-term administration with Lactobacillus plantarum ZDY2013. 2016. Journal Dairy Sci. 99:6913-6921.

Xu, et al., A genomic view of the human-Bacteroides thetaiotaomicron symbiosis. Science. Mar. 28, 2003; 299(5615):2074-6.

Xu, et al., Differential development of murine dendritic cells by GM-CSF versus Flt3 ligand has implications for inflammation and trafficking. J. Immunology. 2007;179(11):7577-7584.

Xu, et al., The endogenous hydrogen sulfide producing enzyme cystathionine-i synthase contributes to visceral hypersensitivity in a rat model of irritable bowel syndrome. Molecular Pain, Biomed central, London, GB. Aug. 6, 2009; 5(1):p. 44.

Xu, J. et al., "Message from a human gut symbiont: sensitivity is a prerequisite for sharing", Trends in microbiology, 12(1), Jan. 1, 2004: pp. 21-28, XP055253932.

Yang, Changa et al., Non-invasive imaging of toll-like receptor 5 expressing using 131 labelled mAb in the mice bearing H22 tumors, Oncol. Lett. 2014., 7(6).1919-1924., Published online Apr. 2014.i12. DOI: 10.3892/ol.2014.2025.

Yang, Fang et al., The clinical significance of the imbalance of TH17 and Treg cells and their related cytokines in peripheral blood of Parkinson's disease patients, Int J Clin Exp Med, 2016:9(9):17946-17951.

Yang, J. et al., Targeting Th17 cells in autoimmune diseases. Trends Pharmacol Sci. Oct. 2014;35(10):493-500. doi: 10.1016/j.tips.2014. 07.006. Epub Aug. 14, 2014.

Yao, W., et al., Cultivation-Independent Analysis of the Development of the *Lactobacillus* spp. Community in the Intestinal TractofNewbomPiglets (20II) Agricultural Sciences in China, 10 (3), pp. 438-447.

Ye, X. et al., The Role of IL-23/Th17 Pathway in Patients with Primary Immune Thrombocytopenia. (2015) PLoS One. 10(1):e0117704.

(56) References Cited

OTHER PUBLICATIONS

Yin, X. et al., Combined effect of five single nucleotide polymorphisms related to IL23/Th17 pathway in the risk of psoriasis. Immunogenetics. Mar. 2014;66(3):215-8. doi: 10.1007/s00251-013-0756-z. Epub Jan. 14, 2014.
Yoon, et al., Structural basis of TLR5-flagellin recognition and signaling. Science. Feb. 2012; 335(6070):859-864.
Yoshinori Kohwi et al., "Antitumor Effect of Bifidobacterium Infant's in Mice", Gann, 69, 613-618; Oct. 1978.
Yq et al. Therapeutic Modulation of the Gut Microbiota in IBD—More Questions to Be Answered. (2016). J. Dig. Dis., Oct. 15, 1751-2980, 12422, Epub ahead of print.
Yu, Dah-Shyong et al., Bacille Calmette-Guerin can induce cellular apoptosis of urothelial cancer directly through toll-like receptor 7 activation, Kaohsiung Journal of Medical Sciences (2015) 31,391-397.
Yu, et al., Utilization of major fucosylated and sialylated human milk oligosaccharides by isolated human gut microbes. Glycobiology, 2013; 23(11):1281-1292.
Yu, N.Y., Wagner, J.R., Laird, M.R., Meili, G Rey, S., Lo, R., et al. (2010a). PSORTb 3.0: improved protein subcellular localization prediction with refined localization subcategories and predictive capabilities for all prokaryotes. Bioinformatics 26(13), 1608-1615. doi: 10.1093/bioinformatics/btq249.
Yun, J.H., et al., Isolation and characterization of potential pro biotic lactobacilli from pig feces (2009). Journal of Basic Microbiology, 49 (2), pp. 220-226.
Yurdusev, N. et al., Antagonistic Effect Exerted by Three Strictly Anaerobic Strains Against Various Strains of Clostridium Perfringens in Gnotobiotic Rodent Intestines. Can J Microbiol 33, 226-231 (1987).
Yurdusev, N. et al., InfectInunun 57,724-731 (1989).
Yutin, N. and Galperin, M.Y., A genomic update on clostridial phylogeny:Gram-negative spore formers and other misplaced clostridia. Environmental microbiology. Oct. 2013; 15(10): 2631-2641.
Zadori, Denes et al., "Kynurenines in Parkinson's disease: therapeutic perspectives", 2012, Journal of Neural Transmission, 119, 2, 275-283.
Zhang, B. et al., Oral administration of enterococcus faecalis FK-23 suppresses Th17 cell development and attenuates allergic airway responses in mice. International journal of molecular medicine. 2012; 30:248-254.
Zhang, B. et al., The Prevalence of Th17 Cells in Patients With Gastric Cancer. 2008. Biochem Biophys Res Commun 374 (3), 533-537.
Zhang, et al., The Activation of NF-κB in Infiltrated Mononuclear Cells Negatively Correlates with Treg Cell Frequency in Oral Lichen Planus. Inflammation. Aug. 2015;38(4):1683-9. doi: 10.1007/sl 0753-015-0145-x.
Zheng, B. et al., Bifidobacteriu breve attenuates murine dextran sodium sulfate-induced colitis and increases regulatory T cell responses. PLOS one. May 2014; 9(5).
Zheng, B., van Bergenhenegouwen, J., Overbeek, S., van de Kant, H.J., Garssen, J., Folkerts, G., et al. (2014). Bifidobacterium breve attenuates murine dextran sodium sulfate-induced colitis and increases regulatory T cell responses. PLoS One 9(5), e95441. doi: 10.1371/journal.pone.0095441.
Zheng, Bin et al., Bifodobacterium breve Attenuates Murine Dexran Doium Sulfate-Induced Colitis and Increases Regulatory T Cell Responses, Plos One, vol. 9, Isue 5, e95441, May 2014.
Zhongyuan, T. et al., The inflammation regulation effects of enterococcus faecium HDRsEf1 on human enterocyte-like HT-29 cells. Animal cells and systems. Mar. 2016;20(2):70-76.
Zhou et al. Central and peripheral hypersensitivity in the irritable bowel syndrome. 2010. Pain. 148(3): 454-461.
Zhou, Linghong, and Jane A Foster. "Psychobiotics and the gut-brain axis: in the pursuit of happiness." Neuropsychiatric disease and treatment vol. 11 715-23. Mar. 16, 2015, doi:10.2147/NDT.S61997.
Zhu, Changxin et al., Roseburia intestinals inhibits interleukin-17 excretion and promotes regulatory T cells differentiation in colitis, Molecular Medicine Reports, 2018, 17:7567-7574.
Zhu, S. and Qian, Y., IL-17/IL-17 receptor system in autoimmune disease: mechanisms and therapeutic potential. Clinical Science (2012) 122, 487-511.
Zitomersky, N. et al., Characterization of Adherent Bacteroidales from Intestinal Biopsies of Children and Young Adults with Inflammatory Bowel Disease. PLOS one. 2013; 8(6).
Zitvogel, et al., Type I interferons in anticancer immunity. Nature Reviews. Jul. 2015:405-414.
WebMD, Brain Damage: Symptoms, Causes, Treatments, https://www.webmd.com/brain/brain-damage-symptoms-causes-treatments#2, Retrieved from the Internet Apr. 15, 2020.
Carbonnelle, Etienne et al., "MALDI-TOF mass spectrometry tools for bacterial identification in clinical microbiology laboratory", Clinical Biochemistry 44 (2011) 104-109. Epub Jul. 8, 2010.
Patterson, Angela M. et al.," Human Gut Symbiont Roseburia hominis Promotes and Regulates Innate Immunity", Frontiers in Immunology, 8 (2017), 1166, pp. 1-14. Published online Sep. 26, 2017.
Paul P. Tak and Gary S. Firestein, "NF-kB: a key role in inflammatory diseases", The Journal of Clinical Investigation, Jan. 2001, vol. 107, No. 1, pp. 1-7.
Auriemma, Matteo et al., "Cytokines and T cells in atopic dermatitis", Eur. Cytokine Netw., vol. 24, No. 1, Mar. 2013, pp. 37-44.
Cryan, John F. and Dinan, Timothy G.,"Mind-Altering Microorganisms: The Impact of The Gut Microbiota on Brain and Behavior", Nature Reviews, Neuroscience, vol. 13, Oct. 2012, 701-712.

\* cited by examiner

FIG. 1 Inhibition of LPS-induced IL-6 secretion in MG U373 cells
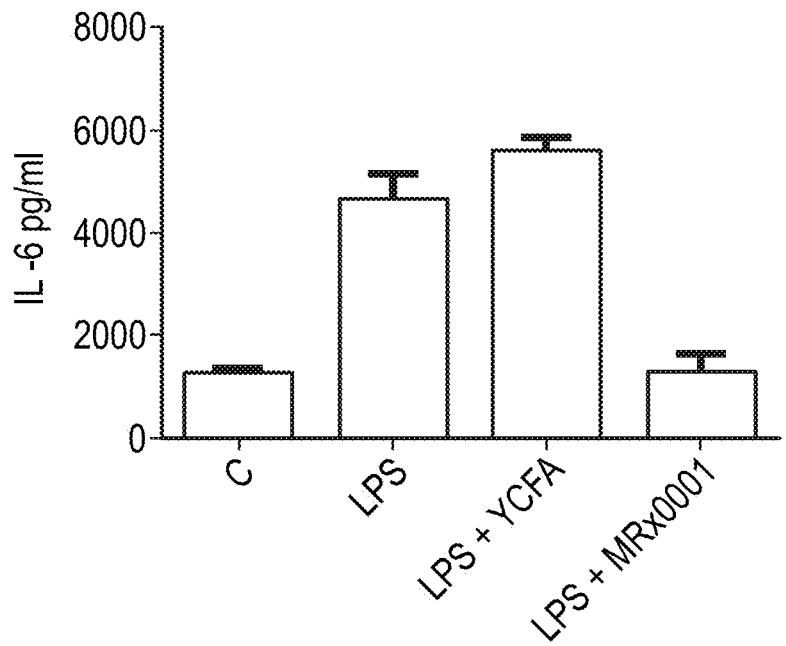
FIG. 2 Inhibition of a-synuclein-induced NFkB-AP1 activation in HEK-TLR4
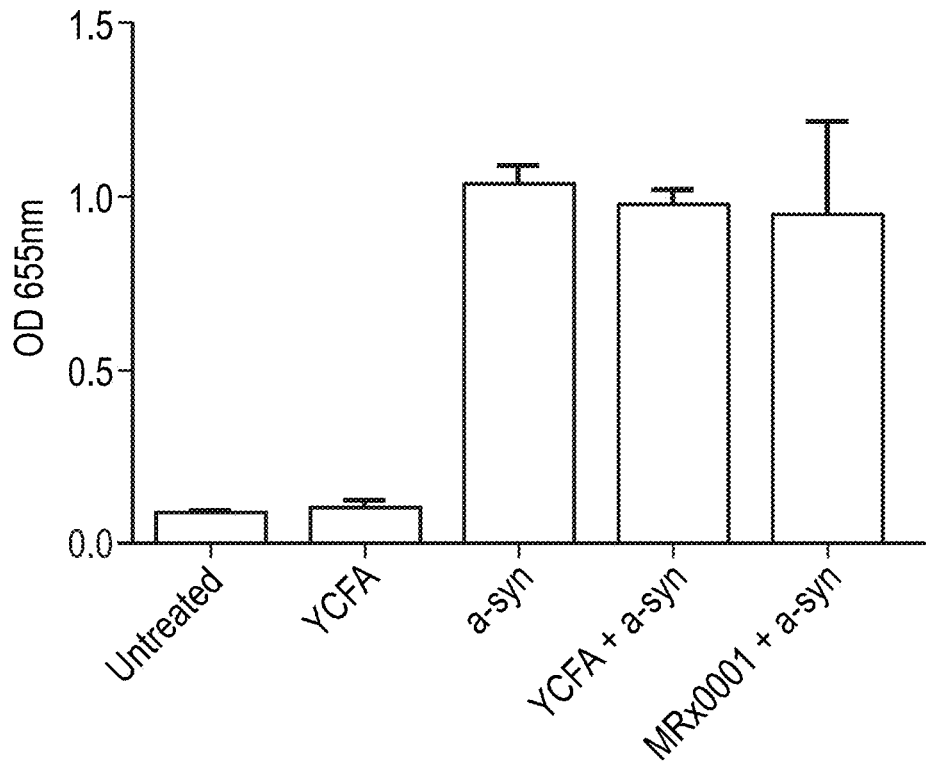

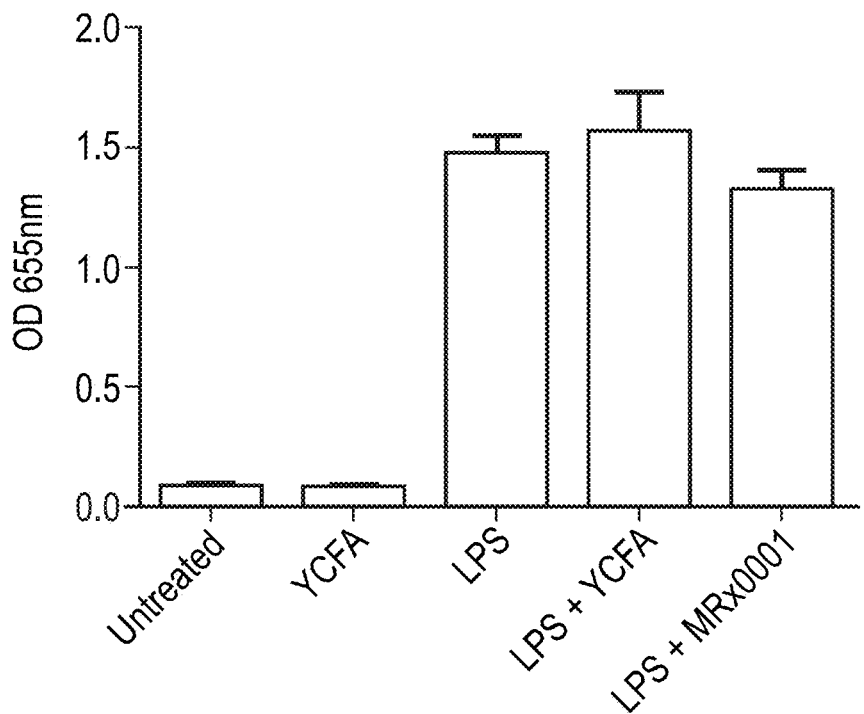
FIG. 3 Inhibition of LPS-induced NFkB-AP1 activation in HEK-TLR4
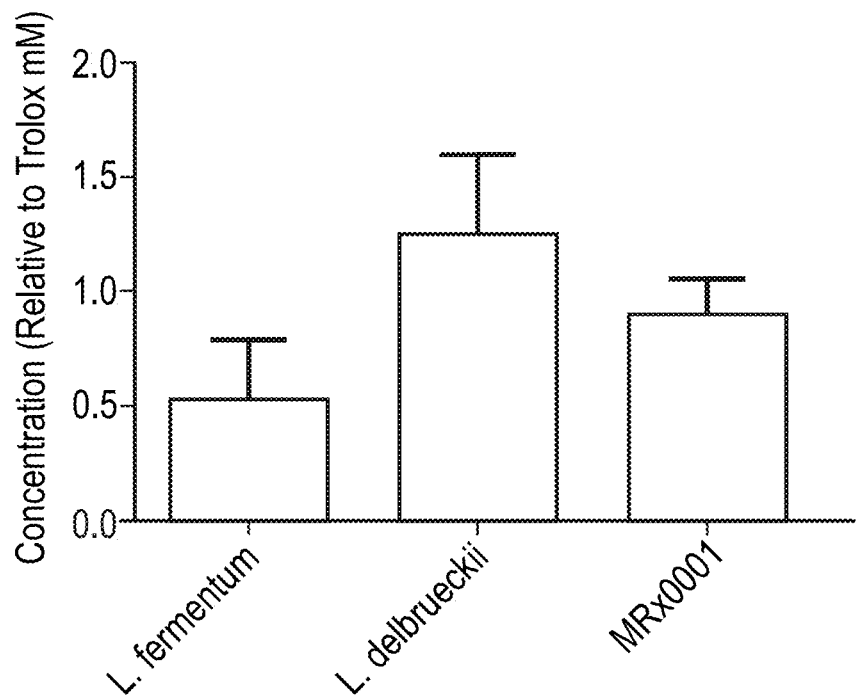
FIG. 4 Antioxidant Capacity Assay

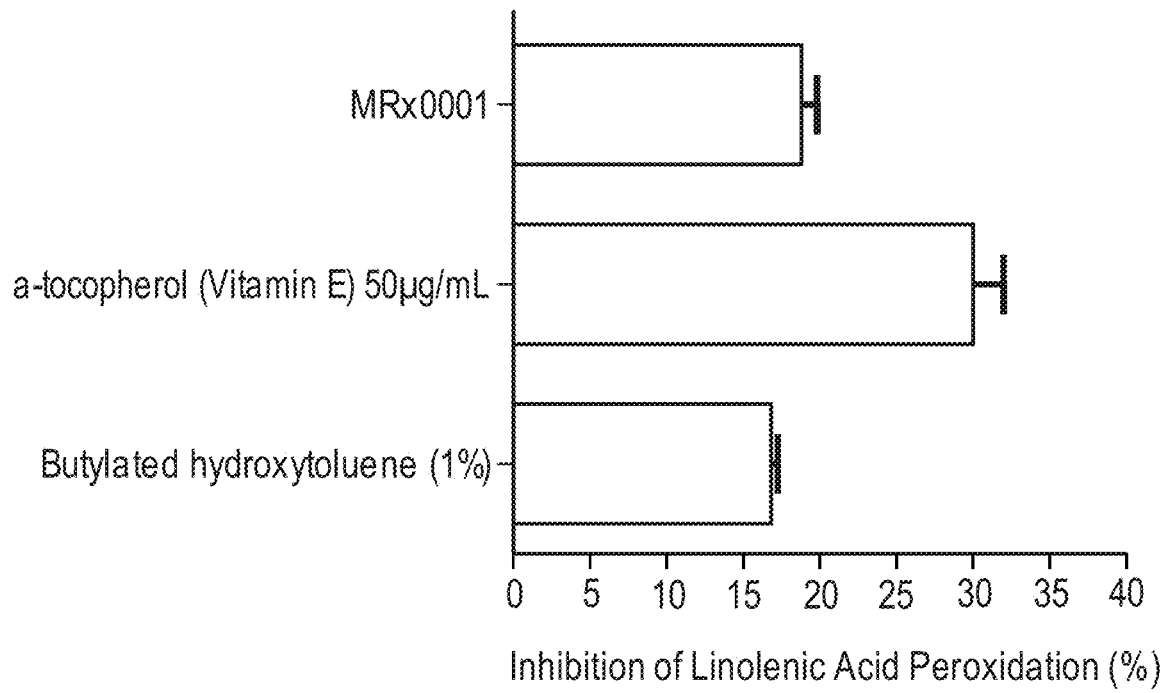
FIG. 5 Total Antioxidant Capacity
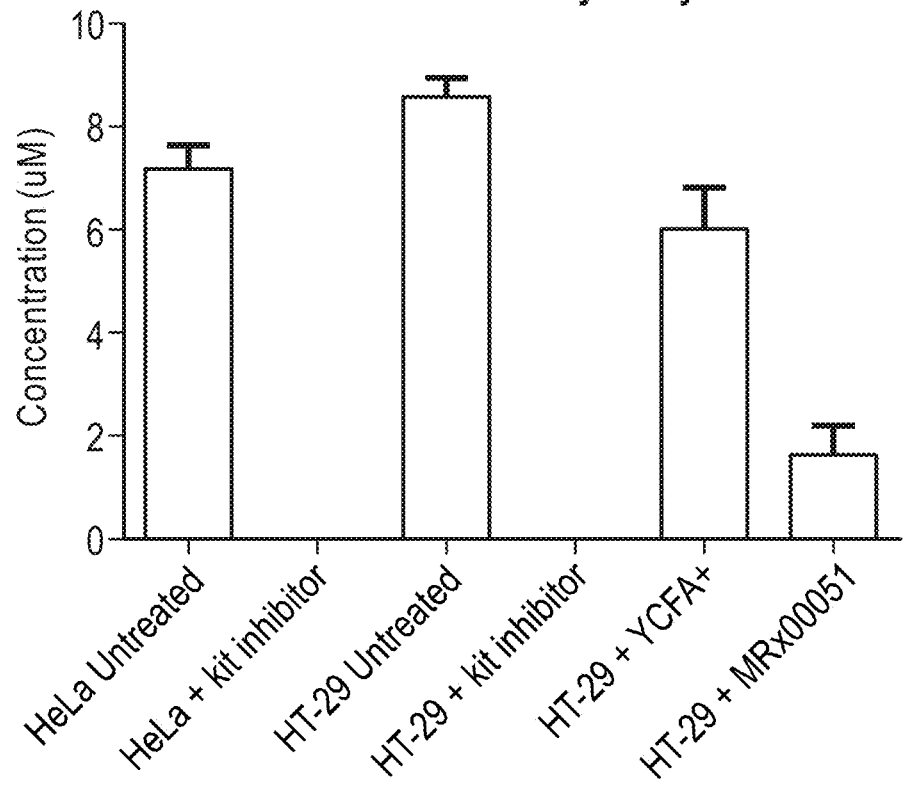
FIG. 6 HDAC activity assay

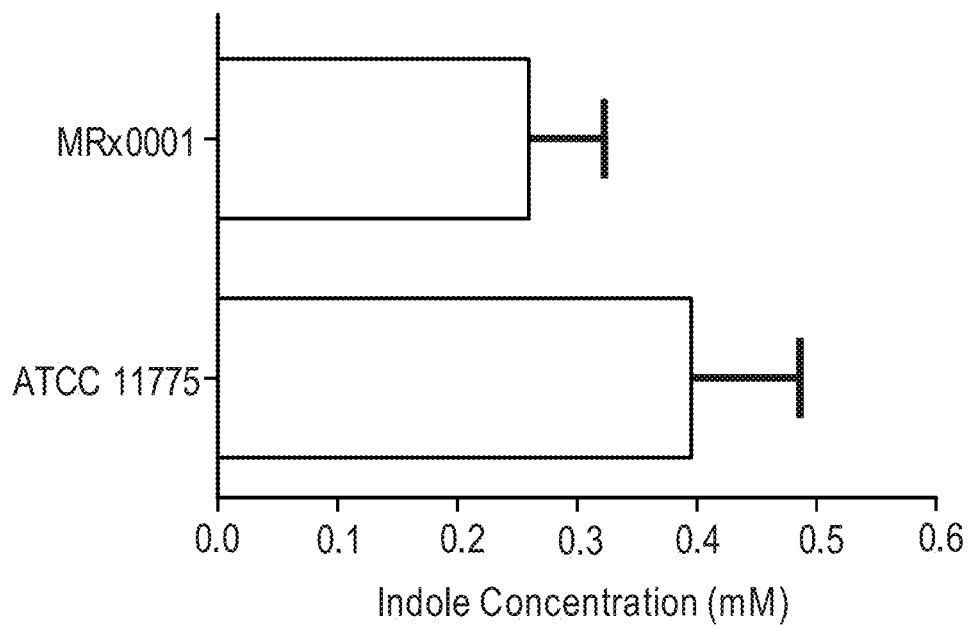
FIG. 7 Indole Assay
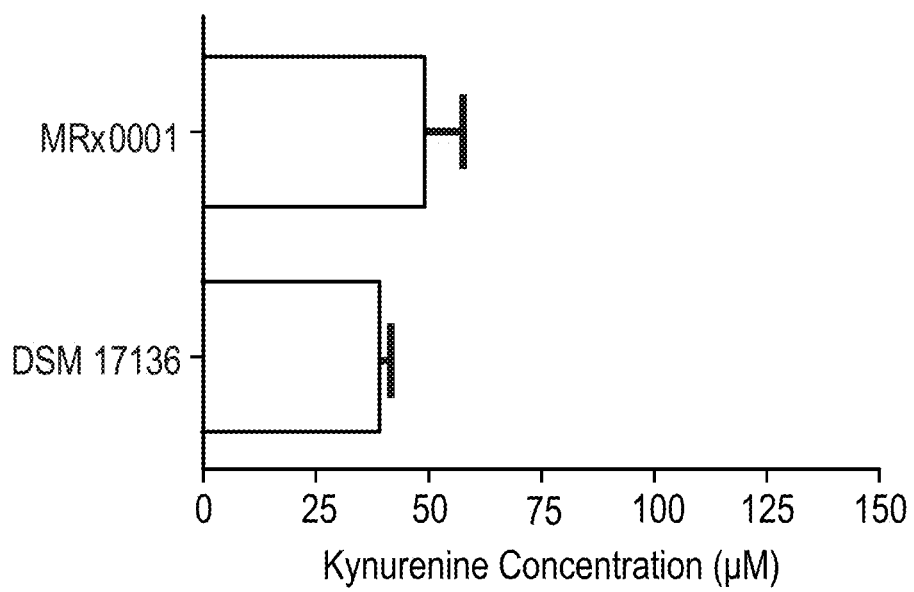
FIG. 8 Kynurenine Assay

FIG. 11A
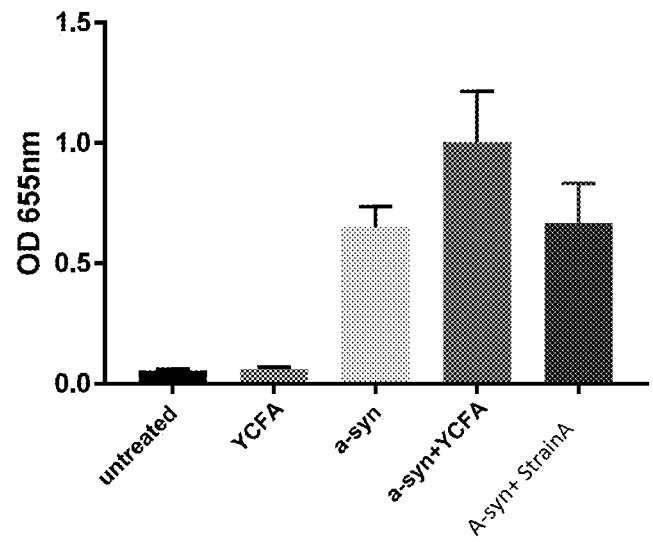
Inhibition of a-syn inducedf NFkB-AP1 promoter in HEK-TLR4 (N=2)
Inhibition of LPS induced NFkB-AP1 promoter in HEK-TLR4 (N=2)
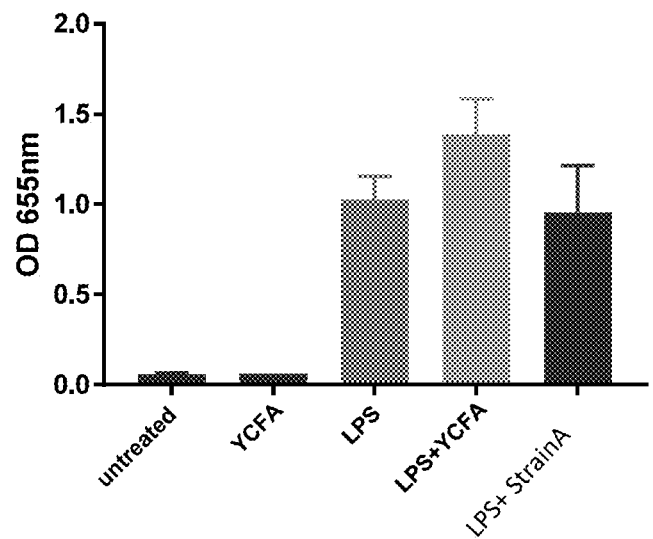
FIG. 11B

FIG. 12A
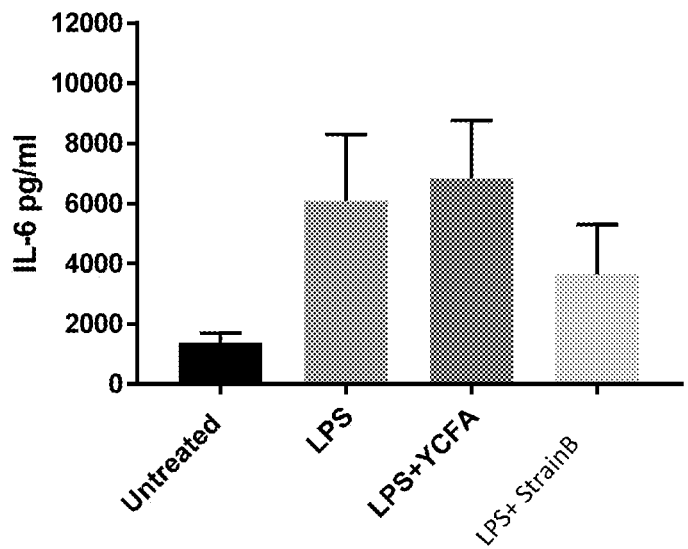
Inhibition of IL-6 secretion in U373 (N=2)
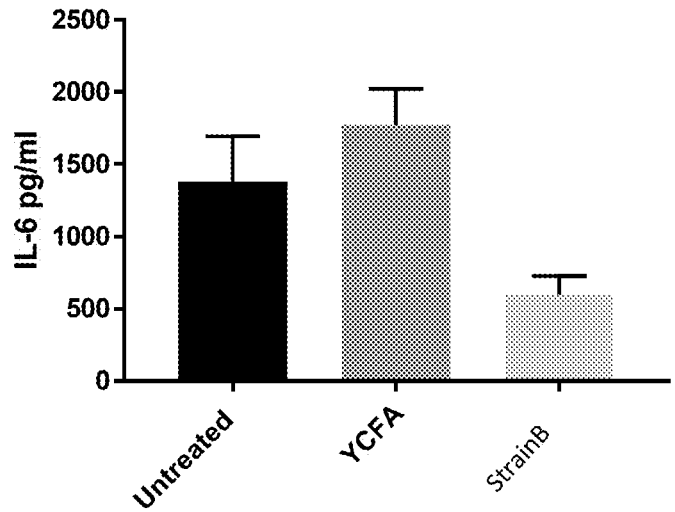
Inhibition of IL-6 secretion in U373 (N=2)
FIG. 12B

FIG. 13A
inhibtion of a-syn induced NF-KB Ap-1 promoter activation in HEK-TLR4 (N=2)
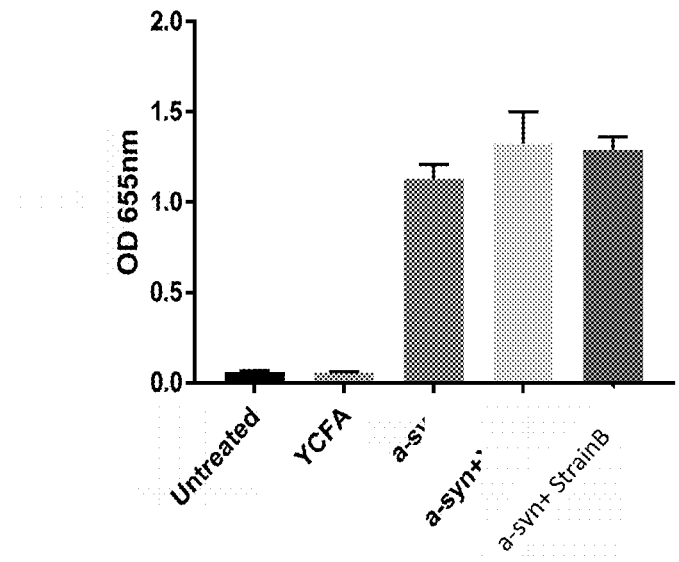
Inhibition of LPS induced NFkB-AP1 promoter in HEK-TLR4 (N=2)
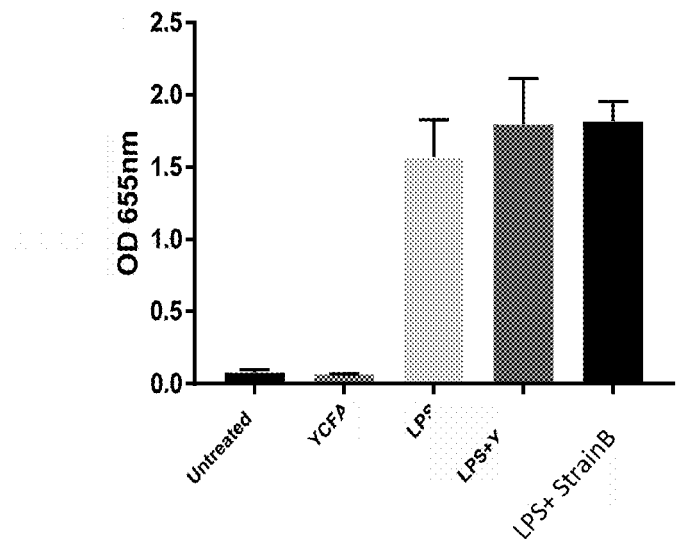
FIG. 13B

COMPOSITIONS COMPRISING BACTERIAL STRAINS

CROSS-REFERENCE

This application is a continuation of International Application No. PCT/EP2018/065808, filed Jun. 14, 2018, which claims the benefit of Great Britain Application No. 1709466.5, filed Jun. 14, 2017, and Great Britain Application No. 1709533.2, filed Jun. 15, 2017 all of which are hereby incorporated by reference in their entirety.

SEQUENCE LISTING

The instant application contains a Sequence Listing which has been submitted electronically in ANSI format and is hereby incorporated by reference in its entirety. Said ANSI copy, created on Jan. 20, 2020, is named 56708-728_301_SL.txt and is 4,680,747 bytes in size.

TECHNICAL FIELD

This invention is in the field of compositions comprising bacterial strains isolated from the mammalian digestive tract and the use of such compositions in the treatment of disease.

BACKGROUND TO THE INVENTION

The human intestine is thought to be sterile in utero, but it is exposed to a large variety of maternal and environmental microbes immediately after birth. Thereafter, a dynamic period of microbial colonization and succession occurs, which is influenced by factors such as delivery mode, environment, diet and host genotype, all of which impact upon the composition of the gut microbiota, particularly during early life. Subsequently, the microbiota stabilizes and becomes adult-like [1]. The human gut microbiota contains more than 500-1000 different phylotypes belonging essentially to two major bacterial divisions, the Bacteroidetes and the Firmicutes [2]. The successful symbiotic relationships arising from bacterial colonization of the human gut have yielded a wide variety of metabolic, structural, protective and other beneficial functions. The enhanced metabolic activities of the colonized gut ensure that otherwise indigestible dietary components are degraded with release of by-products providing an important nutrient source for the host. Similarly, the immunological importance of the gut microbiota is well-recognized and is exemplified in germfree animals which have an impaired immune system that is functionally reconstituted following the introduction of commensal bacteria [3-5].

Dramatic changes in microbiota composition have been documented in gastrointestinal disorders such as inflammatory bowel disease (IBD). For example, the levels of *Clostridium* cluster XIVa bacteria are reduced in IBD patients whilst numbers of *E. coli* are increased, suggesting a shift in the balance of symbionts and pathobionts within the gut [6-9].

In recognition of the potential positive effect that certain bacterial strains may have on the animal gut, various strains have been proposed for use in the treatment of various diseases (see, for example, [10-13]). Also, certain strains, including mostly *Lactobacillus* and *Bifidobacterium* strains, have been proposed for use in treating various inflammatory and autoimmune diseases that are not directly linked to the intestines (see [14] and [15] for reviews). The ability of *Roseburia hominis* to regulate the immune system has been suggested in [16]. However, the relationship between different diseases and different bacterial strains, and the precise effects of particular bacterial strains on the gut and at a systemic level and on any particular types of diseases are poorly characterised, particularly for neurodegenerative disorders.

Recently, there has been increased interest in the art regarding alterations in the gut microbiome that may play a pathophysiological role in human brain diseases [17]. Preclinical and clinical evidence are strongly suggesting a link between brain development and microbiota [18]. A growing body of preclinical literature has demonstrated bidirectional signalling between the brain and the gut microbiome, involving multiple neurocrine and endocrine signalling systems. Indeed, increased levels of *Clostridium* species in the microbiome have been linked to brain disorders [19], and an imbalance of the Bacteroidetes and Finnicutes phyla has also been implicated in brain development disorders [20]. Suggestions that altered levels of gut commensals, including those of *Bifidobacterium, Lactobacillus, Sutterella, Prevotella* and *Ruminococcus* genera and of the Alcaligenaceae family are involved in immune-mediated central nervous system (CNS) disorders, are questioned by studies suggesting a lack of alteration in the microbiota between patients and healthy subjects [10]. *Roseburia hominis* has been proposed for treating a variety of disorders including asthma, rheumatoid arthritis and multiple sclerosis [21]

Like asthma and rheumatoid arthritis, multiple sclerosis is primarily mediated by the immune system. The immune system attacks myelinated axons in the central nervous system, destroying the myelin called plaques or lesions. Demyelination occurs in particular in the optic nerves, subpial spinal cord, brainstem, cerebellum, and juxtacortical and periventricular white matter regions.

As such, multiple sclerosis has a different pathology to other neurodegenerative diseases, such as Parkinson's disease, Alzheimer's disease or dementia. For example, multiple sclerosis is commonly diagnosed in patients in their 20s and 30s, while many other neurodegenerative diseases, such as Parkinson's disease, Alzheimer's and dementia, are diagnosed predominantly in patients aged over 65 years old.

Parkinson's disease, like many neurodegenerative diseases, is primarily mediated by the accumulation of misfolded protein. Parkinson's disease is a synucleinopathology that involves the accumulation of α-synuclein, which aggregate as insoluble fibrils in Lewy bodies within the cytoplasm of the neuronal body. The accumulation of α-synuclein is toxic and impairs the functions of mitochondria, lysosomes, and endoplasmic reticulum, and interferes with microtubule transport.

Nonsteroidal anti-inflammatory drugs (NSAIDs) such as ibuprofen, have been tested for their efficacy in treating a variety of neurological diseases, but the clinical impact of NSAIDs on neurodegenerative diseases like Parkinson's disease remains unclear. While some studies showed that chronic NSAID use is protective against Parkinson's disease, other studies could not confirm the existence of a significant relationship. A recent meta-analysis indicated that the use of non-aspirin NSAID, particularly ibuprofen, reduces the risk of PD by 15% while the use of aspirin did not show any effect [22].

This indicates that, at present, the practical effect of the link between the microbiome and human brain diseases is poorly characterised. Accordingly, more direct analytical studies are required to identify the therapeutic impact of altering the microbiome on neurodegenerative disorders.

There is a requirement in the art for new methods of treating neurodegenerative disorders. There is also a requirement for the potential effects of gut bacteria to be characterised so that new therapies using gut bacteria can be developed.

SUMMARY OF THE INVENTION

The inventors have developed new therapies for treating and preventing neurodegenerative disorders. The inventors have identified that bacterial strains from the genus *Roseburia* may be effective for treating neurodegenerative diseases. As described in the examples, administration of compositions comprising *Roseburia hominis* can protect against reactive oxygen species and prevent inflammation, thus acting as a neuroprotectant. The inventors have also identified that treatment with *Roseburia hominis* can reduce the activation of proinflammatory molecules, such as NFκB and IL-6, by LPS and mutant α-synuclein A53T. The inventors have identified that treatment with *Roseburia hominis* can reduce histone deacetylation activity and lipid peroxidation in vitro, which can help to reduce cell death and apoptosis. The inventors have also identified that *Roseburia hominis* can produce indole that can attenuate inflammation and oxidative stress. Furthermore, the inventors have demonstrated that treatment with *Roseburia hominis* can increase kynurenine levels.

In a first embodiment, the invention provides a composition comprising a bacterial strain of the genus *Roseburia*, for use in a method of treating or preventing a neurodegenerative disorder.

In particular embodiments, the invention provides a composition comprising a bacterial strain of the genus *Roseburia*, for use in a method of treating or preventing a disease or condition selected from the group consisting of: Parkinson's disease, including progressive supranuclear palsy, progressive supranuclear palsy, Steele-Richardson-Olszewski syndrome, normal pressure hydrocephalus, vascular or arteriosclerotic parkinsonism and drug-induced parkinsonism; Alzheimer's disease, including Benson's syndrome; multiple sclerosis; Huntington's disease; amyotrophic lateral sclerosis; Lou Gehrig's disease; motor neurone disease; prion disease; spinocerebellar ataxia; spinal muscular atrophy; dementia, including Lewy body, vascular and frontotemporal dementia; primary progressive aphasia; mild cognitive impairment; HIV-related cognitive impairment and corticobasal degeneration.

In preferred embodiments, the invention provides a composition comprising a bacterial strain of the genus *Roseburia*, for use in a method of treating or preventing Parkinson's disease, such as environmental, familial or Parkinson's associated with general inflammatory status. The inventors have identified that treatment with *Roseburia* strains can reduce the activation of proinflammatory molecules, such as NFκB and IL-6, by LPS and mutant α-synuclein A53T in in vitro models of environmental and familial Parkinson's. In preferred embodiments, the invention provides a composition comprising a bacterial strain of the species *Roseburia hominis*, for use in the treatment of Parkinson's disease. Compositions using *Roseburia hominis* may be particularly effective for treating Parkinson's.

In preferred embodiments of the invention, the bacterial strain in the composition is of *Roseburia hominis*. Closely related strains may also be used, such as bacterial strains that have a 16SrRNA sequence that is at least 95%, 96%, 97%, 98%, 99%, 99.5% or 99.9% identical to the 16S rRNA sequence of a bacterial strain of *Roseburia hominis*. Preferably, the bacterial strain has a 16S rRNA sequence that is at least 95%, 96%, 97%, 98%, 99%, 99.5% or 99.9% identical to SEQ ID NO:1, 2 or 3. Preferably, the sequence identity is to SEQ ID NO:3. Preferably, the bacterial strain for use in the invention has the 16S rRNA sequence represented by SEQ ID NO:3.

In certain embodiments, the composition of the invention is for oral administration. Oral administration of the strains of the invention can be effective for neurodegenerative disorders. Also, oral administration is convenient for patients and practitioners and allows delivery to and/or partial or total colonisation of the intestine.

In certain embodiments, the composition of the invention comprises one or more pharmaceutically acceptable excipients or carriers.

In certain embodiments, the composition of the invention comprises a bacterial strain that has been lyophilised. Lyophilisation is an effective and convenient technique for preparing stable compositions that allow delivery of bacteria.

In certain embodiments, the invention provides a food product comprising the composition as described above.

In certain embodiments, the invention provides a vaccine composition comprising the composition as described above.

Additionally, the invention provides a method of treating or preventing neurodegenerative disorders, comprising administering a composition comprising a bacterial strain of the genus *Roseburia*.

In certain embodiments of the invention, the composition is for use in treating brain injury. The neuroprotective activity of the compositions of the invention and their ability to reduce levels of histone deacetylase activity (HDAC) may make them useful for treating brain injury. In preferred embodiments, the compositions of the invention are for use in treating stroke, such as treating brain injury resulting from a stroke.

In developing the above invention, the inventors have identified and characterised a bacterial strain that is particularly useful for therapy. The *Roseburia intestinalis* strain of the invention is shown to be effective for treating cancer. The invention also provides compositions comprising such cells, or biologically pure cultures of such cells. The invention also provides a cell of the *Roseburia intestinalis* strain deposited under accession number NCIMB 43043, or a derivative thereof, for use in therapy, in particular for cancer.

BRIEF DESCRIPTION OF DRAWINGS

FIG. 1: Downregulation of IL-6 secretion
FIG. 2: Inhibition of α-synuclein induced NFκB promoter activation
FIG. 3: Inhibition of LPS induced NFκB promoter activation
FIG. 4: Change in antioxidant capacity
FIG. 5: Change in total anti-oxidant capacity (lipid oxidation)
FIG. 6: Change in histone deacetylatase (HDAC) activity
FIG. 7: Level of Indole production
FIG. 8: Level of Kyrunenine production
FIGS. 11A-11B:
FIG. 11A) Inhibition of α-synuclein induced NFκB promoter activation and FIG. 11B) Inhibition of LPS induced NFκB promoter activation by strain A
FIGS. 12A-12B: Downregulation of IL-6 secretion by strain B: Inhibition of IL-6 secretion in U373 (FIG. 12A); Inhibition of IL-6 secretion in U373 (FIG. 12B)

FIGS. 13A-13B: FIG. 13A) Inhibition of α-synuclein induced NFκB promoter activation and FIG. 13B) Inhibition of LPS induced NFκB promoter activation by strain B

DISCLOSURE OF THE INVENTION

Bacterial Strains

Figure 9:
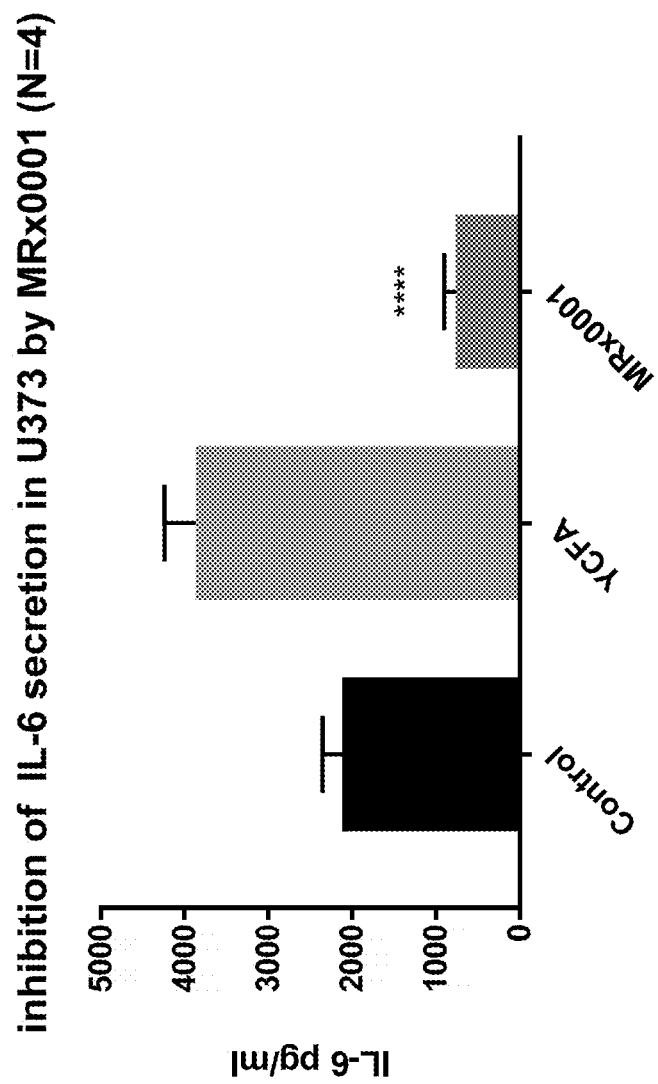
FIG. 9: Downregulation of IL-6 secretion by MRX001

The compositions of the invention comprise a bacterial strain of the genus *Roseburia*. The examples demonstrate that bacteria of this genus are useful for treating or preventing neurodegenerative disorders. The preferred bacterial strains are of the species *Roseburia hominis*, *Roseburia faecis* and *Roseburia intestinalis*.

Examples of *Roseburia* species for use in the invention include *Roseburia hominis*, *Roseburia cecicola*, *Roseburia faecis*, *Roseburia intestinalis*, and *Roseburia inulinivorans*. *Roseburia* bacteria are slightly curved rod-shaped cells that are strictly anaerobic and indigenous to the mammalian intestine. They are of the phylogenetic cluster XIVa within the Firmicutes phylum. The bacteria are butyrate-producing and are actively motile through multiple flagella present along the concave side and in a cluster at one end [23]. *Roseburia hominis* and *Roseburia intestinalis* are recently described examples.

An example of *Roseburia hominis* is the strain deposited under the terms of the Budapest Treaty at National Collections of Industrial, Food and Marine Bacteria (NCIMB) at NCIMB Ltd, Ferguson Building, Craibstone Estate, Bucksburn, Aberdeen, UK, AB21 9YA, on 21 Oct. 2004 by the Rowett Research Institute under the accession number NCIMB 14029$^T$ *Roseburia hominis* A2-183$^T$ (DSM=16839$^T$). Other exemplary *Roseburia hominis* strains are described in [24]. GenBank/EMBL/DDBJ accession numbers for the 16S rRNA gene sequence of strains of *Roseburia hominis* are AY804148 and AJ270482 (disclosed herein as SEQ ID NO:1 and SEQ ID NO:2).

An example of *Roseburia intestinalis* is the strain deposited under the accession number NCIMB 13810 *Roseburia intestinalis* L1-82$^T$ (DSM=14610$^T$). Another example is the *Roseburia intestinalis* strain as described in [24]. Reference [24] also describes exemplary *Roseburia faecis* and *Roseburia inulinivorans* strains.

The *Roseburia hominis* bacterium deposited under accession number NCIMB 42383 was tested in the Examples and is also referred to herein as strain 433. A 16S rRNA sequence for the 433 strain that was tested is provided in SEQ ID NO:3. Strain 433 was deposited with the international depositary authority NCIMB, Ltd. (Ferguson Building, Aberdeen, AB21 9YA, Scotland) by GT Biologics Ltd. (Life Sciences Innovation Building, Aberdeen, AB25 2ZS, Scotland) on 12th Mar. 2015 as "*Roseburia hominis* 433" and was assigned accession number NCIMB 42383. GT Biologics Ltd. subsequently changed its name to 4D Pharma Research Limited.

WO 2016/203221 describes administration of strain 433 to mice and shows that it can affect disease processes outside of the gut (such as asthma and arthritis). Strain 433 also affects disease processes outside of the gut in the treatment of neurodegenerative disorders described herein.

A genome sequence for strain 433 is provided in SEQ ID NO:4. This sequence was generated using the PacBio RS II platform.

The *Roseburia intestinalis* bacterium deposited under accession number NCIMB 43043 was tested in the Examples and is also referred to herein as strain A. A 16S rRNA sequence for strain A that was tested is provided in SEQ ID NO:5. Strain A was deposited with the international depositary authority NCIMB, Ltd. (Ferguson Building, Aberdeen, AB21 9YA, Scotland) by 4D Pharma Research Limited (Life Sciences Innovation Building, Aberdeen, AB25 2ZS, Scotland) on 3 May 2018 as "*Roseburia intestinalis*" and was assigned accession number NCIMB 43043.

The examples also describe a *Roseburia faecis* bacterium that was tested and referred to as strain B. A 16S rRNA sequence for strain B that was tested is provided in SEQ ID NO:6.

In certain embodiments, the bacterial strain for use in the invention is *Roseburia hominis*. In certain embodiments, the bacterial strain for use in the invention is *Roseburia intestinalis*. In certain embodiments, the bacterial strain for use in the invention is *Roseburia faecis*.

Bacterial strains closely related to the strain tested in the examples are also expected to be effective for treating or preventing neurodegenerative disease diseases and conditions mediated by IL-17 or the Th17 pathway. In certain embodiments, the bacterial strain for use in the invention has a 16S rRNA sequence that is at least 95%, 96%, 97%, 98%, 99%, 99.5% or 99.9% identical to the 16S rRNA sequence of a bacterial strain of *Roseburia hominis*. Preferably, the bacterial strain for use in the invention has a 16S rRNA sequence that is at least 95%, 96%, 97%, 98%, 99%, 99.5% or 99.9% identical to SEQ ID NO:1, 2 or 3. Preferably, the sequence identity is to SEQ ID NO:3. Preferably, the bacterial strain for use in the invention has the 16S rRNA sequence represented by SEQ ID NO:3.

In other embodiments, the bacterial strain for use in the invention has a 16S rRNA sequence that is at least 95%, 96%, 97%, 98%, 99%, 99.5% or 99.9% identical to the 16S rRNA sequence of a bacterial strain of *Roseburia intestinalis*. Preferably, the bacterial strain for use in the invention has a 16S rRNA sequence that is at least 95%, 96%, 97%, 98%, 99%, 99.5% or 99.9% identical to SEQ ID NO:5. Preferably, the bacterial strain for use in the invention has the 16S rRNA sequence represented by SEQ ID NO:5.

In other embodiments, the bacterial strain for use in the invention has a 16S rRNA sequence that is at least 95%, 96%, 97%, 98%, 99%, 99.5% or 99.9% identical to the 16S rRNA sequence of a bacterial strain of *Roseburia faecis*. Preferably, the bacterial strain for use in the invention has a 16S rRNA sequence that is at least 95%, 96%, 97%, 98%, 99%, 99.5% or 99.9% identical to SEQ ID NO:6. Preferably, the bacterial strain for use in the invention has the 16S rRNA sequence represented by SEQ ID NO:6.

Bacterial strains that are biotypes of the bacterium deposited under accession number 42383 or NCIMB 43043 are also expected to be effective for treating or preventing neurodegenerative disorders. A biotype is a closely related strain that has the same or very similar physiological and biochemical characteristics.

Strains that are biotypes of the bacterium deposited under accession number NCIMB 42383 or NCIMB 43043 and that are suitable for use in the invention may be identified by sequencing other nucleotide sequences for the bacterium deposited under accession number NCIMB 42383 or NCIMB 43043. For example, substantially the whole genome may be sequenced and a biotype strain for use in the invention may have at least 95%, 96%, 97%, 98%, 99%, 99.5% or 99.9% sequence identity across at least 80% of its whole genome (e.g. across at least 85%, 90%, 95% or 99%, or across its whole genome). Other suitable sequences for use in identifying biotype strains may include hsp60 or repetitive sequences such as BOX, ERIC, (GTG)$_5$ (SEQ ID NO: 7), or REP or [25]. Biotype strains may have sequences with at least 95%, 96%, 97%, 98%, 99%, 99.5% or 99.9% sequence identity to the corresponding sequence of the bacterium deposited under accession number NCIMB 42383 or NCIMB 43043.

In certain embodiments, the bacterial strain for use in the invention has a genome with sequence identity to SEQ ID NO:4. In preferred embodiments, the bacterial strain for use in the invention has a genome with at least 90% sequence identity (e.g. at least 92%, 94%, 95%, 96%, 97%, 98%, 99% or 100% sequence identity) to SEQ ID NO:4 across at least 60% (e.g. at least 65%, 70%, 75%, 80%, 85%, 95%, 96%, 97%, 98%, 99% or 100%) of SEQ ID NO:4. For example, the bacterial strain for use in the invention may have a genome with at least 90% sequence identity to SEQ ID NO:4 across 70% of SEQ ID NO:4, or at least 90% sequence identity to SEQ ID NO:4 across 80% of SEQ ID NO:4, or at least 90% sequence identity to SEQ ID NO:4 across 90% of SEQ ID NO:4, or at least 90% sequence identity to SEQ ID NO:4 across 100% of SEQ ID NO:4, or at least 95% sequence identity to SEQ ID NO:4 across 70% of SEQ ID NO:4, or at least 95% sequence identity to SEQ ID NO:4 across 80% of SEQ ID NO:4, or at least 95% sequence identity to SEQ ID NO:4 across 90% of SEQ ID NO:4, or at least 95% sequence identity to SEQ ID NO:4 across 100% of SEQ ID NO:4, or at least 98% sequence identity to SEQ ID NO:4 across 70% of SEQ ID NO:4, or at least 98% sequence identity to SEQ ID NO:4 across 80% of SEQ ID NO:4, or at least 98% sequence identity to SEQ ID NO:4 across 90% of SEQ ID NO:4, or at least 98% sequence identity to SEQ ID NO:4 across 100% of SEQ ID NO:4.

Alternatively, strains that are biotypes of the bacterium deposited under accession number NCIMB 42383 or NCIMB 43043 and that are suitable for use in the invention may be identified by using the accession number NCIMB 42383 or NCIMB 43043 deposit and restriction fragment analysis and/or PCR analysis, for example by using fluorescent amplified fragment length polymorphism (FAFLP) and repetitive DNA element (rep)-PCR fingerprinting, or protein profiling, or partial 16S or 23S rDNA sequencing. In preferred embodiments, such techniques may be used to identify other *Roseburia hominis, Roseburia faecis* and *Roseburia intestinalis* strains.

In certain embodiments, strains that are biotypes of the bacterium deposited under accession number NCIMB 42383 or NCIMB 43043 and that are suitable for use in the invention are strains that provide the same pattern as the bacterium deposited under accession number NCIMB 42383 or NCIMB 43043 when analysed by amplified ribosomal DNA restriction analysis (ARDRA), for example when using Sau3AI restriction enzyme (for exemplary methods and guidance see, for example,[25]). Alternatively, biotype strains are identified as strains that have the same carbohydrate fermentation patterns as the bacterium deposited under accession number NCIMB 42383 or NCIMB 43043.

Other *Roseburia* strains that are useful in the compositions and methods of the invention, such as biotypes of the bacteria deposited under accession number NCIMB 42383 or NCIMB 43043, may be identified using any appropriate method or strategy, including the assays described in the examples. For instance, strains for use in the invention may be identified by culturing with neuroblastoma cells and then assessing cytokine levels and levels of neuroprotection or neuroproliferation. In particular, bacterial strains that have similar growth patterns, metabolic type and/or surface antigens to the bacterium deposited under accession number NCIMB 42383 or NCIMB 43043 may be useful in the invention. A useful strain will have comparable immune modulatory activity to the NCIMB 42383 or NCIMB 43043 strain. In particular, a biotype strain will elicit comparable effects on the neurodegenerative disease models and comparable effects on cytokine levels to the effects shown in the Examples, which may be identified by using the culturing and administration protocols described in the Examples.

A particularly preferred strain of the invention is the *Roseburia hominis* strain deposited under accession number NCIMB 42383. This is the exemplary 433 strain tested in the examples and shown to be effective for treating disease. Therefore, the invention provides a cell, such as an isolated cell, of the *Roseburia hominis* strain deposited under accession number NCIMB 42383, or a derivative thereof. The invention also provides a composition comprising a cell of the *Roseburia hominis* strain deposited under accession number NCIMB 42383, or a derivative thereof. The invention also provides a biologically pure culture of the *Roseburia hominis* strain deposited under accession number NCIMB 42383. The invention also provides a cell of the *Roseburia hominis* strain deposited under accession number NCIMB 42383, or a derivative thereof, for use in therapy, in particular for the diseases described herein.

A particularly preferred strain of the invention is the *Roseburia intestinalis* strain deposited under accession number NCIMB 43043. This is the exemplary strain A tested in the examples and shown to be effective for treating disease. Therefore, the invention provides a cell, such as an isolated cell, of the *Roseburia intestinalis* strain deposited under accession number NCIMB 43043, or a derivative thereof. The invention also provides a composition comprising a cell of the *Roseburia intestinalis* strain deposited under accession number NCIMB 43043, or a derivative thereof. The invention also provides a biologically pure culture of the *Roseburia intestinalis* strain deposited under accession number NCIMB 43043. The invention also provides a cell of the *Roseburia intestinalis* strain deposited under accession number NCIMB 43043, or a derivative thereof, for use in therapy, in particular for the diseases described herein.

A derivative of the strain deposited under accession number NCIMB 42383 or NCIMB 43043 may be a daughter strain (progeny) or a strain cultured (subcloned) from the original. A derivative of a strain of the invention may be modified, for example at the genetic level, without ablating the biological activity. In particular, a derivative strain of the invention is therapeutically active. A derivative strain will have comparable immune modulatory activity to the original NCIMB 42383 or NCIMB 43043 strain. In particular, a derivative strain will elicit comparable effects on the neurodegenerative disease models and comparable effects on cytokine levels to the effects shown in the Examples, which may be identified by using the culturing and administration protocols described in the Examples. A derivative of the NCIMB 42383 or NCIMB 43043 strain will generally be a biotype of the NCIMB 42383 or NCIMB 43043 strain.

References to cells of the *Roseburia hominis* strain deposited under accession number NCIMB 42383 encompass any cells that have the same safety and therapeutic efficacy characteristics as the strains deposited under accession number NCIMB 42383, and such cells are encompassed by the invention.

References to cells of the *Roseburia intestinalis* strain deposited under accession number NCIMB 43043 encompass any cells that have the same safety and therapeutic efficacy characteristics as the strains deposited under accession number NCIMB 43043, and such cells are encompassed by the invention.

In preferred embodiments, the bacterial strains in the compositions of the invention are viable and capable of partially or totally colonising the intestine.

The invention further provides a cell, such as an isolated cell, of the *Enterococcus gallinarum* strain deposited under accession number NCIMB 42761, or a derivative thereof. The invention also provides a composition comprising a cell of the *Roseburia intestinalis* strain deposited under accession number NCIMB 42761, or a derivative thereof. The invention also provides a biologically pure culture of the *Roseburia intestinalis* strain deposited under accession number NCIMB 43043. The invention also provides a cell of the *Roseburia intestinalis* strain deposited under accession number NCIMB 43043, or a derivative thereof, for use in therapy, in particular for the diseases described herein. A derivative of the strain deposited under accession number NCIMB 43043 may be a daughter strain (progeny) or a strain cultured (subcloned) from the original.

A derivative of a strain of the invention may be modified, for example at the genetic level, without ablating the biological activity. In particular, a derivative strain of the invention is therapeutically active. A derivative strain will have comparable immune modulatory activity to the original NCIMB 42761 strain. In particular, a derivative strain will elicit comparable effects on the neurodegenerative disease models to the effects shown in the Examples, which may be identified by using the culturing and administration protocols described in the Examples. A derivative of the NCIMB 43043 strain will generally be a biotype of the NCIMB 43043 strain.

References to cells of the *Roseburia intestinalis* strain deposited under accession number NCIMB 43043 encompass any cells that have the same safety and therapeutic efficacy characteristics as the strain deposited under accession number NCIMB 43043, and such cells are encompassed by the invention. Thus, in some embodiments, reference to cells of the *Roseburia intestinalis* strain deposited under accession number NCIMB 43043 refers only to the strain A deposited under NCIMB 43043 and does not refer to a bacterial strain that was not deposited under NCIMB 43043.

In preferred embodiments, the bacterial strain in the compositions of the invention is viable and capable of partially or totally colonising the intestine.

Therapeutic Uses

As demonstrated in the examples, the bacterial compositions of the invention are effective for treating neurodegenerative disorders. In particular, treatment with compositions of the invention increase neuroproliferation and act as a neuroprotectant against agents that destroy dopaminergic neurons. Therefore, the compositions of the invention may be useful for treating or preventing neurodegenerative disorders that are the result of neuron death.

Compositions of the invention can decrease the activation of the NFκB promoter, which activates cytokine production, for example IL-1β, IL-1α, IL-18, TNFα and IL-6. Treating cells with mutant α-synuclein is a model for familial Parkinson's. A point mutation at position 53 from adenine to threonine leads to α-synuclein mis-folding. The incorrectly folded α-synuclein subsequently aggregates into insoluble fibrils which form Lewy bodies. Therefore, the compositions of the invention may be useful for treating or preventing neurodegenerative disorders that are the result of neuroinflammation, protein misfolding and/or environmental exposure. Compositions of the invention can be used for treatment of familial Parkinson's. Activation of the NFκB promoter is mediated through the TLR4 ligand. TL4 is known to mediate cell death in the mouse model MPTP, which simulates Parkinson's disease. Compositions of the invention can be used to inhibit the ability of TLR4 signalling to activate the NFκB promoter. Of particular relevance for PD, both TLR2 and TLR4 were found to be upregulated in brains of PD patients [26]. Moreover α-syn has been described as a ligand for TLR2 [27] and we have demonstrated that α-syn is also a ligand for TLR4 using HEK-TLR4 cells.

Compositions of the invention decrease the secretion of pro-inflammatory cytokines such as IL-6, which can be induced by lipopolysaccharide (LPS). Treatment of cells with LPS simulates Parkinson's caused by environmental factors. Compositions of the invention can be used to decrease IL-6 secretion. Compositions of the invention can be used for treatment of environmental Parkinson's.

Examples of neurodegenerative diseases to be treated by compositions of the invention include: Parkinson's disease, including progressive supranuclear palsy, progressive supranuclear palsy, Steele-Richardson-Olszewski syndrome, normal pressure hydrocephalus, vascular or arteriosclerotic parkinsonism and drug-induced parkinsonism; Alzheimer's disease, including Benson's syndrome; multiple sclerosis; Huntington's disease; amyotrophic lateral sclerosis; Lou Gehrig's disease; motor neurone disease; prion disease; spinocerebellar ataxia; spinal muscular atrophy; dementia, including Lewy body, vascular and frontotemporal dementia; primary progressive aphasia; mild cognitive impairment; HIV-related cognitive impairment and corticobasal degeneration. A further neurodegenerative diseases to be treated by compositions of the invention is progressive inflammatory neuropathy.

In certain embodiments, the compositions of the invention can be effective for treating neurodegenerative disorders that occur in elderly patients. The examples show that compositions of the invention can treat Parkinson's disease which is predominantly diagnosed in patients aged over 65 years old. In preferred embodiments, the compositions of the invention are for treating patients 65 years or older. In other certain embodiments, the patients are between 40 to 65 years old. In other embodiments, the patients are older than 40 years. In certain embodiments, the compositions of the invention are for use in treating a disease associated with old age, for example, a disease diagnosed after 50 years of age.

In certain embodiments, the compositions of the invention are for use in treating a neurodegenerative disorder mediated or characterised by the accumulation of protein, in particular mis-folded protein.

In certain embodiments, the compositions of the invention are for use in treating a neurodegenerative disorder associated with grey matter neuronal loss. In certain embodiments, the compositions of the invention are for treating a neurodegenerative disorder that is not associated with white matter lesions.

In certain embodiments, the compositions of the invention are for use in treating a neurodegenerative disorder associated with permanent symptoms.

In certain embodiments, the compositions of the invention are for use in treating a neurodegenerative disorder that is not an auto-immune disorder. In certain embodiments, the compositions of the invention are for use in treating a neurodegenerative disorder that is not multiple sclerosis.

In certain embodiments, the compositions of the invention are for use in reducing neuron death, in particular, in the treatment of neurodegenerative disorders. In certain embodiments, the compositions of the invention are for use in protecting neurons, in particular in the treatment of neurodegenerative disorders.

The neuroprotective properties of the compositions of the invention, as shown in the examples, mean that the compositions may be particularly effective for preventing or delaying onset or progression of neurodegenerative disorders. In certain embodiments, the compositions of the invention are for use in delaying onset or progression of a neurodegenerative disorders.

Modulation of the Microbiota-Gut-Brain Axis

Communication between the gut and the brain (the microbiota-gut-brain axis) occurs via a bidirectional neurohumoral communication system. Recent evidence shows that the microbiota that resides in the gut can modulate brain development and produce behavioural phenotypes via the microbiota-gut-brain axis. Indeed, a number of reviews suggest a role of the microbiota-gut-brain axis in maintaining central nervous system functionality and implicate dysfunction of the microbiota-gut-brain axis in the development of central nervous system disorders and conditions [17],[20],[28].

The bidirectional communication between the brain and the gut (i.e. the-gut-brain axis) includes the central nervous system, neuroendocrine and neuroimmune systems, including the hypothalamus-pituitary-adrenal (HPA) axis, sympathetic and parasympathetic arms of the autonomic nervous system (ANS), including the enteric nervous system (ENS) and the vagus nerve, and the gut microbiota.

As demonstrated in the examples, the compositions of the present invention can modulate the microbiota-gut-brain axis and reduce cell death associated with neurodegenerative disorders. Accordingly, the compositions of the invention may be useful for treating or preventing neurodegenerative disorders, in particular those disorders and conditions associated with dysfunction of the microbiota-gut-brain axis.

In particular embodiments, the compositions of the invention may be useful for treating or preventing a disease or condition selected from the group consisting of: Parkinson's disease, including progressive supranuclear palsy, progressive supranuclear palsy, Steele-Richardson-Olszewski syndrome, normal pressure hydrocephalus, vascular or arteriosclerotic parkinsonism and drug-induced parkinsonism; Alzheimer's disease, including Benson's syndrome; multiple sclerosis; Huntington's disease; amyotrophic lateral sclerosis; Lou Gehrig's disease; motor neurone disease; prion disease; spinocerebellar ataxia; spinal muscular atrophy; dementia; including Lewy body; vascular and frontotemporal dementia; primary progressive aphasia; mild cognitive impairment; HIV-related cognitive impairment and corticobasal degeneration.

The compositions of the invention may be particularly useful for treating or preventing chronic disease, treating or preventing disease in patients that have not responded to other therapies (such as treatment with Levodopa, dopamine agonists, MAO-B inhibitors, COMT inhibitors, Glutamate antagonists, and/or anticholinergics), and/or treating or preventing the tissue damage and symptoms associated with dysfunction of the microbiota-gut-brain axis.

In certain embodiments, the compositions of the invention modulate the CNS. In some embodiments, the compositions of the invention modulate the autonomic nervous system (ANS). In some embodiments, the compositions of the invention modulate the enteric nervous system (ENS). In some embodiments, the compositions of the invention modulate the hypothalamic, pituitary, adrenal (HPA) axis. In some embodiments, the compositions of the invention modulate the neuroendocrine pathway. In some embodiments, the compositions of the invention modulate the neuroimmune pathway. In some embodiments, the compositions of the invention modulate the CNS, the ANS, the ENS, the HPA axis and/or the neuroendocrine and neuroimmune pathways. In certain embodiments, the compositions of the invention module the levels of commensal metabolites and/or the gastrointestinal permeability of a subject. In certain embodiments, the compositions of the invention modulate the dopaminergic system.

The signalling of the microbiota-gut-brain axis is modulated by neural systems. Accordingly, in some embodiments, the compositions of the invention modulate signalling in neural systems. In certain embodiments, the compositions of the invention modulate the signalling of the central nervous system. In some embodiments, the compositions of the invention modulate signalling in sensory neurons. In other embodiments, the compositions of the invention modulate signalling in motor neurons. In some embodiments, the compositions of the invention modulate the signalling in the ANS. In some embodiments, the ANS is the parasympathetic nervous system. In preferred embodiments, the compositions of the invention modulate the signalling of the vagus nerve. In other embodiments, the ANS is the sympathetic nervous system. In other embodiments, the compositions of the invention modulate the signalling in the enteric nervous system. In certain embodiments, the signalling of ANS and ENS neurons responds directly to luminal contents of the gastrointestinal tract. In other embodiments, the signalling of ANS and ENS neurons responds indirectly to neurochemicals produced by luminal bacteria. In other embodiments, the signalling of ANS and ENS neurons responds to neurochemicals produced by luminal bacteria or enteroendocrine cells. In certain preferred embodiments, the neurons of the ENS activate vagal afferents that influence the functions of the CNS. In some embodiments, the compositions of the invention regulate the activity of enterochromaffin cells.

Neurodegenerative Diseases

Tauopathies are neurodegenerative diseases associated with the pathological aggregation of tau protein in neurofibrillary or gliofibrillary tangles in the human brain. Alzheimer's disease is an example of a tauopathology. Synucleinopathies (also called α-Synucleinopathies) are neurodegenerative diseases characterised by the abnormal accumulation of aggregates of α-synuclein in neurons, nerve fibres or glial cells. Parkinson's disease is an example of a synucleinopathology.

There is clinical and pathological overlap between these two pathologies. Parkinson's disease patients frequently have dementia and Alzheimer's disease patients often manifest parkinsonism [29]. For example, progressive supranuclear palsy (also known as Steele-Richardson-Olszewski syndrome) has a tauopathology, but also leads to prominent parkinsonism [30]. Mutations in LRRK2 known to cause parkinsonism are associated with the accumulation of synuclein, tau, neither, or both proteins [31].

Lewy body disease (LBD) is a neurodegenerative disease that is one of the most common causes of dementia in the elderly. LBD exemplifies the existence of a continuum between tau- and synuclein-pathologies. LBD shares clinical and pathological features with Parkinson disease, Parkinson disease dementia and Alzheimer disease [29].

In particular embodiments, the compositions of the invention may be useful for treating or preventing tauopathies and/or synucleinopathies. In particular embodiments, the compositions of the invention may be useful for treating or preventing tauopathies. In particular embodiments, the compositions of the invention may be useful for treating or preventing synucleinopathies. In certain embodiments, the compositions of the invention may be useful for treating or preventing a disease or condition selected from the group consisting of: Parkinson's disease, including progressive supranuclear palsy, progressive supranuclear palsy, Steele-Richardson-Olszewski syndrome, normal pressure hydrocephalus, vascular or arteriosclerotic parkinsonism and drug-induced parkinsonism; Alzheimer's disease, including Benson's syndrome; and dementia; including Lewy body; vascular and frontotemporal dementia.

In preferred embodiments, the compositions of the invention may be useful for treating or preventing Parkinson's disease, including progressive supranuclear palsy, progressive supranuclear palsy, Steele-Richardson-Olszewski syndrome, normal pressure hydrocephalus, vascular or arteriosclerotic parkinsonism and drug-induced parkinsonism. In preferred embodiments, the compositions of the invention may be useful for treating or preventing Alzheimer's disease, including Benson's syndrome. In further preferred embodiments, the compositions of the invention may be useful for treating or preventing dementia; including Lewy body; vascular and frontotemporal dementia.

Parkinson's Disease

Parkinson's disease is a common neurodegenerative disease neuropathologically characterised by degeneration of heterogeneous populations of neural cells (dopamine-producing cells). The clinical diagnosis of Parkinson's disease requires bradykinesia and at least one of the following core symptoms: resting tremor; muscle rigidity and postural reflex impairment. Other signs and symptoms that may be present or develop during the progression of the disease are autonomic disturbances (sialorrhoea, seborrhoea, constipation, micturition disturbances, sexual functioning, orthostatic hypotension, hyperhydrosis), sleep disturbances and disturbances in the sense of smell or sense of temperature. Parkinson's disease is a neurodegenerative diseases that may develop or persist due to dysfunction of the microbiota-gut-brain axis. Therefore, in preferred embodiments, the compositions of the invention are for use in treating or preventing Parkinson's disease in a subject.

In further preferred embodiments, the invention provides a composition comprising a bacterial strain of the genus *Roseburia*, for use in a method of treating or preventing Parkinson's disease. Compositions comprising a bacterial strain of the genus *Roseburia* may improve motor and cognitive functions in models of Parkinson's disease. Treatment with *Roseburia* strains may modulate signalling in the central, autonomic and enteric nervous systems; may modulate the activity of the HPA axis pathway; may modulate neuroendocrine and/or neuroimmune pathways; and may modulate the levels of commensal metabolites, inflammatory markers and/or gastrointestinal permeability of a subject, all of which are implicated in the neuropathology of Parkinson's disease. In preferred embodiments, the invention provides a composition comprising a bacterial strain of the species *Roseburia hominis* for use in a method of treating or preventing Parkinson's disease. Compositions using *Roseburia hominis* may be particularly effective for treating Parkinson's disease.

In preferred embodiments, the compositions of the invention prevent, reduce or alleviate one or more of the symptoms of Parkinson's disease in a subject. In preferred embodiments, the compositions of the invention prevent, reduce or alleviate one or more core symptoms of Parkinson's disease in a subject. In certain embodiments, the compositions of the invention prevent, reduce or alleviate bradykinesia in a subject. In certain embodiments, the compositions of the invention prevent, reduce or alleviate resting tremor; muscle rigidity and/or postural reflex impairment in a subject. In certain embodiments, the compositions of the invention prevent, reduce or alleviate one or more symptoms associated with Parkinson's disease progression selected from autonomic disturbances (sialorrhoea, seborrhoea, constipation, micturition disturbances, sexual functioning, orthostatic hypotension, hyperhydrosis), sleep disturbances and disturbances in the sense of smell or sense of temperature.

In preferred embodiments, the compositions of the invention prevent, reduce or alleviate depressive symptoms comorbid with Parkinson's disease. In certain embodiments, the compositions of the invention improve verbal memory and/or executive functions. In certain embodiments, the compositions of the invention improve attention, working memory, verbal fluency and/or anxiety.

In other preferred embodiments, the compositions of the invention prevent, reduce or alleviate cognitive dysfunctions comorbid with Parkinson's disease.

In certain embodiments, the compositions of the invention prevent, reduce or alleviate Parkinson's disease progression. In certain embodiments, the compositions of the invention prevent, reduce or alleviate later motor complications. In certain embodiments, the compositions of the invention prevent, reduce or alleviate late motor fluctuations. In certain embodiments, the compositions of the invention prevent, reduce or alleviate neuronal loss. In certain embodiments, the compositions of the invention improve symptoms of Parkinson's disease dementia (PDD). In certain embodiments, the compositions of the invention prevent, reduce or alleviate impairment of executive function, attention and/or working memory. In certain embodiments, the compositions of the invention improve dopaminergic neurotransmission. In certain embodiments, the compositions of the invention prevent, reduce or alleviate impaired dopaminergic neurotransmission.

In some embodiments, the compositions of the invention improve the symptoms of Parkinson's disease according to a symptomatic or diagnostic scale. In certain embodiments, the tests for assessing symptomatic improvement of motor function in Parkinson's disease is the Unified Parkinson's Disease Rating Scale. In particular, UPDRS II considers the activity of daily life and UPDRS III considers motor-examination.

In some embodiments, the compositions of the invention improve the symptoms associated the PDD according to a symptomatic or diagnostic test and/or scale. In certain embodiments, the test or scale is selected from the Hopkins Verbal Learning Test—Revised (HVLT-R); the Delis-Kaplan Executive Function System (D-KEFS) Color-Word Interference Test; the Hamilton Depression Rating Scale (HAM-D 17; depression); the Hamilton Anxiety Rating Scale (HAM-A; anxiety) and the Unified Parkinson's Disease Rating Scale (UPDRS; PD symptom severity).

In some embodiments, the compositions of the invention improve the Clinical Global Impression—Global Improvement (CGI-I) scale for assessing psychiatric and neurological disorders. In some embodiments, the compositions of the invention display a positive effect on global social and occupational impairment of the subject with Parkinson's disease.

Alzheimer's Disease and Dementia

In DSM-5, the term dementia was replaced with the terms major neurocognitive disorder and mild neurocognitive disorder. Neurocognitive disorder is a heterogeneous class of psychiatric diseases. The most common neurocognitive disorder is Alzheimer's disease, followed by vascular dementias or mixed forms of the two. Other forms of neurodegenerative disorders (e.g. Lewy body disease, frontotemporal dementia, Parkinson's dementia, Creutzfeldt-Jakob disease, Huntington's disease, and Wernicke-Korsakoff syndrome) are accompanied by dementia.

Alzheimer's disease and dementia are also characterised by neuronal loss, so the neuroprotective and neuroproliferative effects shown in the examples for the compositions of the invention indicate that they may be useful for treating or preventing these conditions.

The symptomatic criteria for dementia under DSM-5 are evidence of significant cognitive decline from a previous level of performance in one or more cognitive domains selected from: learning and memory; language; executive function; complex attention; perceptual-motor and social cognition. The cognitive deficits must interfere with independence in everyday activities. In addition, the cognitive deficits do not occur exclusively in the context of a delirium and are not better explained by another mental disorder (for example MDD or schizophrenia).

In addition to the primary symptom, subjects with neurodegenerative disorders display behavioural and psychiatric symptoms including agitation, aggression, depression, anxiety, apathy, psychosis and sleep-wake cycle disturbances.

Neurodegenerative disorders may develop or persist due to dysfunction of the microbiota-gut-brain axis. Therefore, in preferred embodiments, the compositions of the invention are for use in treating or preventing neurodegenerative disorders in a subject. In preferred embodiments, the neurodegenerative disorder is Alzheimer's disease. In other embodiments, the neurodegenerative disorder is selected from vascular dementias; mixed form Alzheimer's disease and vascular dementia; Lewy body disease; frontotemporal dementia; Parkinson's dementia; Creutzfeldt-Jakob disease; Huntington's disease; and Wernicke-Korsakoff syndrome.

In preferred embodiments, the compositions of the invention prevent, reduce or alleviate one or more of the symptoms of neurodegenerative disorders in a subject. In certain embodiments, the compositions of the invention prevent, reduce or alleviate the occurrence of cognitive decline in a subject. In certain embodiments, the compositions of the invention improve the level of performance of a subject with neurodegenerative disorders in one or more cognitive domains selected from: learning and memory; language; executive function; complex attention; perceptual-motor and social cognition. In some embodiments, the compositions of the invention prevent, reduce or alleviate the occurrence of one or more behavioural and psychiatric symptoms associated with neurodegenerative disorders selected from agitation, aggression, depression, anxiety, apathy, psychosis and sleep-wake cycle disturbances.

In certain embodiments, the compositions of the invention prevent, reduce or alleviate symptomatic disease by intervention in suspected pathogenic mechanisms at a preclinical stage. In certain embodiments, the compositions of the invention improve disease modification, with slowing or arrest of symptom progression. In some embodiments, the slowing or arrest of symptom progression correlates with evidence in delaying the underlying neuropathological process. In preferred embodiments, the compositions of the invention improve symptoms of neurodegenerative disorders comprising enhanced cognitive and functional improvement. In preferred embodiments, the compositions of the invention improve the behavioural and psychiatric symptoms of dementia (BPSD). In preferred embodiments, the compositions of the invention improve the ability of a subject with neurodegenerative disorder to undertake everyday activities.

In preferred embodiments, the compositions of the invention improve both cognition and functioning in a subject with Alzheimer's disease. In some embodiments, the composition of the invention improves the cognitive endpoint in a subject with Alzheimer's disease. In some embodiments, the compositions of the invention improve the functional endpoint in a subject with Alzheimer's disease. In preferred embodiments, the compositions of the invention improve the cognitive and functional endpoint in a subject with Alzheimer's disease. In yet further preferred embodiments, the compositions of the invention improve the overall clinical response (the global endpoint) in a subject with Alzheimer's disease.

In some embodiments, the compositions of the invention improve the symptoms of neurodegenerative disorders according to a symptomatic or diagnostic test. In certain embodiments, the tests for assessing symptomatic improvement of Alzheimer's disease (and other neurodegenerative disorders) are selected from objective cognitive, activities of daily living, global assessment of change, health related quality of life tests and tests assessing behavioural and psychiatric symptoms of neurodegenerative disorders.

In certain embodiments, the objective cognitive tests for assessment of symptomatic improvement use the Alzheimer's disease Assessment Scale cognitive subscale (ADAS-cog) and the classic ADAS scale. In certain embodiments, symptomatic improvement of cognition is assessed using the Neurophysiological Test Battery for Use in Alzheimer's Disease (NTB).

In some embodiments, the global assessment of change test uses the Clinical Global Impression—Global Improvement (CGI-I) scale for assessing psychiatric and neurological disorders. In some embodiments, the global scale is the Clinician's Interview Based Impression of Change plus (CIBIC-plus). In some embodiments, the global scale is the Alzheimer's Disease Cooperative Study Unit Clinician's Global Impression of Change (ADCS-CGIC).

In certain embodiments, the health related quality of life measures are the Alzheimer's Disease-Related QOL (ADRQL) and the QOL-Alzheimer's Disease (QOL-AD).

In certain embodiments, the tests assessing behavioural and psychiatric symptoms of neurodegenerative disorders are selected from the Behavioural pathology in Alzheimer's Disease Rating Scale (BEHAVE-AD); the Behavioural Rating Scale for Dementia (BRSD); the Neuropsychiatric Inventory (NPI); and the Cohen-Mansfield Agitation Inventory (CMAI).

In some embodiments, the compositions of the invention are particularly effective at preventing, reducing or alleviating neurodegenerative disorders when used in combination with another therapy for treating neurodegenerative disorders. In certain embodiments, such therapies include acetylcholinesterase inhibitors including donepezil (Aricept®), galantamine (Razadyne®) and rivastigmine (Exelon®), and memantine.

Neurochemical Factors, Neuropeptides and Neurotransmitters and the Microbiota-Gut-Brain Axis As outlined above, the microbiota-gut-brain axis is modulated by a number of different physiological systems. The microbiota-gut-brain axis is modulated by a number of signalling molecules. Alterations in the levels of these signalling molecules results in neurodegenerative diseases. The experiments performed by the inventors indicate that administration of *Roseburia* species, and in particular *Roseburia hominis*, can modulate levels of indole and kynurenine. Dysregulation of these metabolites can lead to neurodegenerative diseases, such as Parkinson's disease.

In certain embodiments, the compositions of the invention modulate the levels of brain monoamines and metabolites thereof. In preferred embodiments the metabolite is kynurenine. In certain embodiments, the compositions of the invention modulate kynurenine, which is the main route of tryptophan metabolism, which serves as a route to nicotinamide adenine dinucleotide (NAD+) production. Kynurenine can be metabolized to neuroactive compounds such as kynurenic acid (KYNA) and 3-hydroxy-1-kynurenine (3-OH-1-KYN), and in further steps to quinolinic acid (QUIN). Dysregulation of the kynurenine pathway can lead to activation of the immune system and the accumulation of potentially neurotoxic compounds. Alterations in the kynurenine metabolism may be involved in the development of Parkinson's diseases. Kynurenine levels have been demonstrated to be decreased in the frontal cortex, putamen and substantia nigra pars compacta of patients with PD [32]. Therefore, in certain embodiments the compositions of the invention are for use in increasing the levels of kynurenine in the treatment of Parkinson's disease.

In certain embodiments of the invention the compositions of the invention can increase the levels of kynurenin. Increased levels of kynurenine have been shown to attenuated MPP+-induced neuronal cell death in vitro in a human dopaminergic neuroblastoma cell line [33]. In certain embodiments kynurenine and kynurenic acid, can activate GI aryl hydrocarbon receptor (Ahr) and GPR35 receptors. Activation of Ahr receptor induces IL-22 production, which can inhibit local inflammation. Activation of GPR35 inducing the production of inositol triphosphate and Ca2+ mobilization.

In certain embodiments, the compositions of the invention modulate the levels of indole. In preferred embodiments the metabolite is kynurenine. In certain embodiments, the compositions of the invention modulate kynurenine, which is the main route of tryptophan metabolism.

The signalling of the microbiota-gut-brain axis is modulated by levels of neurochemical factors, neuropeptides and neurotransmitters. Accordingly, in certain embodiments, the compositions of the invention modulates levels of neurochemical factors, neuropeptides and neurotransmitters. Accordingly, in certain preferred embodiments, the compositions of the invention directly alter CNS biochemistry.

The signalling of the microbiota-gut-brain axis is modulated by levels of γ-aminobutyric acid (GABA). Accordingly, in preferred embodiments, the compositions of the invention modulate the levels of GABA. GABA is an inhibitory neurotransmitter that reduces neuronal excitability. In certain embodiments, the compositions of the invention increase the levels of GABA. In certain embodiments, the compositions of the invention decrease the levels of GABA. In certain embodiments, the compositions of the invention alter GABAergic neurotransmission. In certain embodiments, the compositions of the invention modulate the level of GABA transcription in different regions of the central nervous system. In certain embodiments, the commensal derived GABA crosses the blood-brain barrier and affects neurotransmission directly. In certain embodiments, the compositions of the invention lead to a reduction of GABA in the hippocampus, amygdala and/or locus coeruleus. In certain embodiments, the compositions of the invention lead to an increase of GABA in cortical regions.

Immune Response

The signalling of the microbiota-gut-brain axis is modulated by alterations in the immune response and inflammatory factors and markers. Accordingly, in certain embodiments, the compositions of the invention may modulate the immune response. In certain embodiments, the compositions of the invention modulate the systemic levels of circulating neuroimmune signalling molecules. In certain preferred embodiments, the compositions of the invention modulate pro-inflammatory cytokine production and inflammation. In certain embodiments, the compositions of the invention modulate the inflammatory state. In certain embodiments, the compositions of the invention decrease IL-6 production and secretion. In certain embodiments, the compositions of the invention decrease the activation of the NFκB promoter. In certain embodiments, the compositions of the invention are able to modulate the activation of IL-6 production by the potent pro-inflammatory endotoxin lipopolysaccharide (LPS). In certain embodiments, the compositions of the invention are able to modulate the activation of the NFκB promoter by LPS and α-synuclein mutant proteins such as A53T. Increased circulating levels of cytokines are closely associated with various neurodegenerative disorders, including Parkinson's, dementia and Alzheimer's. In certain embodiments, the compositions of the invention are for use in reducing IL-6 levels and/or NFκB levels in the treatment of a neurodegenerative disorder.

The signalling of the microbiota-gut-brain axis is modulated by levels of commensal metabolites. Accordingly, in certain embodiments, the compositions of the invention modulate the systemic levels of microbiota metabolites. In certain preferred embodiments, the compositions of the invention modulate the level of short chain fatty acids (SCFAs). In certain embodiments the level of SCFAs is increased or decreased. In some embodiments, the SCFA is butyric acid (BA) (or butyrate). In some embodiments, the SCFA is propionic acid (PPA). In some embodiments, the SCFA is acetic acid. In certain embodiments, the compositions of the invention modulate the ability of SCFAs to cross the blood-brain barrier.

Histone acetylation and deacetylation are important epigenetic regulators of gene expression. An imbalance in histone acetylation and deacetylation can result in apoptosis. Dysregulation of such histone acetyltransferases has been implicated in the pathogenesis associated with age-associated neurodegenerative diseases, such as Parkinson's disease, Huntington's disease, Alzheimer's disease, amyotrophic lateral sclerosis and cognitive decline [34]. Accordingly, in certain embodiments, the compositions of the invention can modulate histone deacetylase activity. In certain embodiments, the compositions of the invention can reduce histone deacetylatase activity. In certain embodiments, the compositions of the invention can reduce histone acetylatase activity.

Patients with neurodegenerative diseases, including Parkinson's disease, Huntington's disease, Alzheimer's disease and amyotrophic lateral sclerosis, exhibit high levels of lipid peroxidation. Lipid are vulnerable to oxidation by reactive oxygen species, and the brain is rich in polyunsaturated fatty acids. Accordingly, in certain embodiments, the compositions of the invention can modulate lipid peroxidation. In certain embodiments, the compositions of the invention can reduce lipid peroxidation. Reducing the oxidative damage caused by reactive oxygen species can be used to target early the stages neurodegenerative diseases. Accordingly, in certain embodiments, the compositions of the invention are for use in treating early stage neurodegeneration. Also accordingly, in certain embodiments, the compositions of the invention are for use in preventing the development of a neurodegenerative disorder. In such embodiments, the compositions of the invention may be for use in a patient that has been identified as at risk of developing a neurodegenerative disorder.

The signalling of the microbiota-gut-brain axis is modulated by levels of gastrointestinal permeability. Accordingly, in some embodiments, the compositions of the invention alter the integrity of the gastrointestinal tract epithelium. In certain embodiments, the compositions of the invention modulate the permeability of the gastrointestinal tract. In certain embodiments, the compositions of the invention modulate the barrier function and integrity of the gastrointestinal tract. In certain embodiments, the compositions of the invention modulate gastrointestinal tract motility. In certain embodiments, the compositions of the invention modulate the translocation of commensal metabolites and inflammatory signalling molecules into the bloodstream from the gastrointestinal tract lumen.

The signalling of the microbiota-gut-brain axis is modulated by microbiome composition in the gastrointestinal tract. Accordingly, in certain embodiments, the compositions of the invention modulates the microbiome composition of the gastrointestinal tract. In certain embodiments, the compositions of the invention prevents microbiome dysbiosis and associated increases in toxic metabolites (e.g. LPS). In certain embodiments, the compositions of the invention modulate the levels of *Clostridium* in the gastrointestinal tract. In preferred embodiments, the compositions of the invention reduce the level of *Clostridium* in the gastrointestinal tract. In certain embodiments, the compositions of the invention reduce the levels of *Campylobacter jejuni*. In certain embodiments, the compositions of the invention modulate the proliferation of harmful anaerobic bacteria and the production of neurotoxins produced by these bacteria. In certain embodiments, the compositions of the invention modulate the microbiome levels of *Lactobacillus* and/or *Bifidobacterium*. In certain embodiments, the compositions of the invention modulate the microbiome levels of Sutterella, *Prevotella, Ruminococcucs* genera and/or the Alcaligenaceae family. In certain embodiments, the compositions of the invention increase the level of *Lactobacillus plantarum* and/or *Saccharomyces boulardii*.

Brain Injury

The examples demonstrate that the compositions of the invention are neuroprotective and have HDAC inhibitory activity. HDAC2 is a crucial target for functional recovery from stroke [35] and HDAC inhibition can prevent white matter injury [36], so the compositions of the invention may be useful in the treatment of brain injury.

In certain embodiments, the compositions of the invention are for use in treating brain injury. In some embodiments, the brain injury is a traumatic brain injury. In some embodiments, the brain injury is an acquired brain injury. In some embodiments, the compositions of the invention are for use in treating brain injury resulting from trauma. In some embodiments, the compositions of the invention are for use in treating brain injury resulting from a tumour. In some embodiments, the compositions of the invention are for use in treating brain injury resulting from a stroke. In some embodiments, the compositions of the invention are for use in treating brain injury resulting from a brain haemorrhage. In some embodiments, the compositions of the invention are for use in treating brain injury resulting from encephalitis. In some embodiments, the compositions of the invention are for use in treating brain injury resulting from cerebral hypoxia. In some embodiments, the compositions of the invention are for use in treating brain injury resulting from cerebral anoxia.

In preferred embodiments, the compositions of the invention are for use in treating stroke. The effects shown in the examples are particularly relevant to the treatment of stroke. Stroke occurs when blood flow to at least a part of the brain is interrupted. Without an adequate supply of blood to provide oxygen and nutrients to the brain tissue and to remove waste products from the brain tissue, brain cells rapidly begin to die. The symptoms of stroke are dependent on the region of the brain which is affected by the inadequate blood flow. Symptoms include paralysis, numbness or weakness of the muscles, loss of balance, dizziness, sudden severe headaches, speech impairment, loss of memory, loss of reasoning ability, sudden confusion, vision impairment, coma or even death. A stroke is also referred to as a brain attack or a cerebrovascular accident (CVA). The symptoms of stroke may be brief if adequate blood flow is restored within a short period of time. However, if inadequate blood flow continues for a significant period of time, the symptoms can be permanent.

In some embodiments, the stroke is cerebral ischemia. Cerebral ischemia results when there is insufficient blood flow to the tissues of the brain to meet metabolic demand. In some embodiments, the cerebral ischemia is focal cerebral ischemia, i.e. confined to a specific region of the brain. In some embodiments the cerebral ischemia is global cerebral ischemia, i.e. encompassing a wide area of the brain tissue. Focal cerebral ischemia commonly occurs when a cerebral vessel has become blocked, either partially or completely, reducing the flow of blood to a specific region of the brain. In some embodiments the focal cerebral ischemia is ischemic stroke. In some embodiments, the ischemic stroke is thrombotic, i.e. caused by a thrombus or blood clot, which develops in a cerebral vessel and restricts or blocks blood flow. In some embodiments the ischemic stroke is a thrombotic stroke. In some embodiments, the ischemic stroke is embolic, i.e. caused by an embolus, or an unattached mass that travels through the bloodstream and restricts or blocks blood flow at a site distant from its point of origin. In some embodiments the ischemic stroke is an embolic stroke. Global cerebral ischemia commonly occurs when blood flow to the brain as a whole is blocked or reduced. In some embodiments the global cerebral ischemia is caused by hypoperfusion, i.e. due to shock. In some embodiments the global cerebral ischemia is a result of a cardiac arrest.

In some embodiments the subject diagnosed with brain injury has suffered cerebral ischemia. In some embodiments, the subject diagnosed with brain injury has suffered focal cerebral ischemia. In some embodiments, the subject diagnosed with brain injury has suffered an ischemic stroke. In some embodiments, the subject diagnosed with brain injury has suffered a thrombotic stroke. In some embodiments, the subject diagnosed with brain injury has suffered an embolic stroke. In some embodiments, the subject diagnosed with brain injury has suffered global cerebral ischemia. In some embodiments, the subject diagnosed with brain injury has suffered hypoperfusion. In some embodiments, the subject diagnosed with brain injury has suffered a cardiac arrest.

In some embodiments, the compositions of the invention are for use in treating cerebral ischemia. In some embodiments, the compositions of the invention are for use in treating focal cerebral ischemia. In some embodiments, the compositions of the invention are for use treating ischemic stroke. In some embodiments, the compositions of the invention are for use in treating thrombotic stroke. In some embodiments, the compositions of the invention are for use in treating embolic stroke. In some embodiments, the compositions of the invention are for use in treating global cerebral ischemia. In some embodiments, the compositions of the invention are for use in treating hypoperfusion.

In some embodiments, the stroke is hemorrhagic stroke. Hemorrhagic stroke is caused by bleeding into or around the brain resulting in swelling, pressure and damage to the cells and tissues of the brain. Hemorrhagic stroke is commonly a result of a weakened blood vessel that ruptures and bleeds into the surrounding brain. In some embodiments, the hemorrhagic stroke is an intracerebral hemorrhage, i.e. caused by bleeding within the brain tissue itself. In some embodiments the intracerebral hemorrhage is caused by an intraparenchymal hemorrhage. In some embodiments the intracerebral hemorrhage is caused by an intraventricular hemorrhage. In some embodiments the hemorrhagic stroke is a subarachnoid hemorrhage i.e. bleeding that occurs outside of the brain tissue but still within the skull. In some embodiments, the hemorrhagic stroke is a result of cerebral amyloid angiopathy. In some embodiments, the hemorrhagic stroke is a result of a brain aneurysm. In some embodiments, the hemorrhagic stroke is a result of cerebral arteriovenous malformation (AVM).

In some embodiments the subject diagnosed with brain injury has suffered hemorrhagic stroke. In some embodiments, the subject diagnosed with brain injury has suffered an intracerebral hemorrhage. In some embodiments, the subject diagnosed with brain injury has suffered an intraparenchymal hemorrhage. In some embodiments, the subject diagnosed with brain injury has suffered an intraventricular hemorrhage. In some embodiments, the subject diagnosed with brain injury has suffered a subarachnoid hemorrhage. In some embodiments, the subject diagnosed with brain injury has suffered cerebral amyloid angiopathy. In some embodiments, the subject diagnosed with brain injury has suffered a brain aneurysm. In some embodiments, the subject diagnosed with brain injury has suffered cerebral AVM.

In some embodiments, the compositions of the invention are for use in treating hemorrhagic stroke. In some embodiments, the compositions of the invention are for use in treating an intracerebral hemorrhage. In some embodiments, the compositions of the invention are for use in treating an intraparenchymal hemorrhage. In some embodiments, the compositions of the invention are for use in treating an intraventricular hemorrhage. In some embodiments, the compositions of the invention are for use in treating a subarachnoid hemorrhage. In some embodiments, the compositions of the invention are for use in treating a cerebral amyloid angiopathy. In some embodiments, the compositions of the invention are for use in treating a brain aneurysm. In some embodiments, the compositions of the invention are for use in treating cerebral AVM.

Restoration of adequate blood flow to the brain after a period of interruption, though effective in alleviating the symptoms associated with stroke, can paradoxically result in further damage to the brain tissue. During the period of interruption, the affected tissue suffers from a lack of oxygen and nutrients, and the sudden restoration of blood flow can result in inflammation and oxidative damage through the induction of oxidative stress. This is known as reperfusion injury, and is well documented not only following stroke, but also following a heart attack or other tissue damage when blood supply returns to the tissue after a period of ischemia or lack of oxygen. In some embodiments the subject diagnosed with brain injury has suffered from reperfusion injury as a result of stroke. In some embodiments, the compositions of the invention are for use in treating reperfusion injury as a result of stroke.

A transient ischemic attack (TIA), often referred to as a mini-stroke, is a recognised warning sign for a more serious stroke. Subjects who have suffered one or more TIAs are therefore at greater risk of stroke. In some embodiments the subject diagnosed with brain injury has suffered a TIA. In some embodiments, the compositions of the invention are for use in treating a TIA. In some embodiments, the compositions of the invention are for use in treating brain injury in a subject who has suffered a TIA.

High blood pressure, high blood cholesterol, a familial history of stroke, heart disease, diabetes, brain aneurysms, arteriovenous malformations, sickle cell disease, vasculitis, bleeding disorders, use of nonsteroidal anti-inflammatory drugs (NSAIDs), smoking tobacco, drinking large amounts of alcohol, illegal drug use, obesity, lack of physical activity and an unhealthy diet are all considered to be risk factors for stroke. In particular, lowering blood pressure has been conclusively shown to prevent both ischemic and hemorrhagic strokes [37, 38]. In some embodiments, the compositions of the invention are for use in treating brain injury in a subject who has at least one risk factor for stroke. In some embodiments the subject has two risk factors for stroke. In some embodiments the subject has three risk factors for stroke. In some embodiments the subject has four risk factors for stroke. In some embodiments the subject has more than four risk factors for stroke. In some embodiments the subject has high blood pressure. In some embodiments the subject has high blood cholesterol. In some embodiments the subject has a familial history of stroke. In some embodiments the subject has heart disease. In some embodiments the subject has diabetes. In some embodiments the subject has a brain aneurysm. In some embodiments the subject has arteriovenous malformations. In some embodiments the subject has vasculitis. In some embodiments the subject has sickle cell disease. In some embodiments the subject has a bleeding disorder. In some embodiments the subject has a history of use of nonsteroidal anti-inflammatory drugs (NSAIDs). In some embodiments the subject smokes tobacco. In some embodiments the subject drinks large amounts of alcohol. In some embodiments the subject uses illegal drugs. In some embodiments the subject is obese. In some embodiments the subject is overweight. In some embodiments the subject has a lack of physical activity. In some embodiments the subject has an unhealthy diet.

The examples indicate that the compositions of the invention may be useful for treating brain injury and aiding recovery when administered before the injury event occurs. Therefore, the compositions of the invention may be particularly useful for treating brain injury when administered to subjects at risk of brain injury, such as stroke.

In certain embodiments, the compositions of the invention are for use in reducing the damage caused by a potential brain injury, preferably a stroke. The compositions may reduce the damage caused when they are administered before the potential brain injury occurs, in particular when administered to a patient identified as at risk of a brain injury.

The examples indicate that the compositions of the invention may be useful for treating brain injury and aiding recovery when administered after the injury event occurs. Therefore, the compositions of the invention may be particularly useful for treating brain injury when administered to subjects following a brain injury, such as stroke.

In some embodiments, the compositions of the invention treat brain injury by reducing motoric damage. In some embodiments, the compositions of the invention treat brain injury by improving motor function. In some embodiments, the compositions of the invention treat brain injury by improving muscle strength. In some embodiments, the compositions of the invention treat brain injury by improving memory. In some embodiments, the compositions of the invention treat brain injury by improving social recognition. In some embodiments, the compositions of the invention treat brain injury by improving neurological function.

Treatment of brain injury may refer to, for example, an alleviation of the severity of symptoms. Treatment of brain injury may also refer to reducing the neurological impairments following stroke. Compositions of the invention for use in treating stroke may be provided to the subject in advance of the onset of stroke, for example in a patient identified as being at risk of stroke. Compositions of the invention for use in treating stroke may be provided after a stroke has occurred, for example, during recovery. Compositions of the invention for use in treating stroke may be provided during the acute phase of recovery (i.e. up to one week after stroke). Compositions of the invention for use in treating stroke may be provided during the subacute phase of recovery (i.e. from one week up to three months after stroke). Compositions of the invention for use in treating stroke may be provided during the chronic phase of recovery (from three months after stroke).

In certain embodiments, the compositions of the invention are for use in combination with a secondary active agent. In certain embodiments, the compositions of the invention are for use in combination with aspirin or tissue plasminogen activator (tPA). Other secondary agents include other antiplatelets (such as clopidogrel), anticoagulants (such as heparins, warfarin, apixaban, dabigatran, edoxaban or rivaroxaban), antihypertensives (such as diuretics, ACE inhibitors, calcium channel blockers, beta-blockers or alpha-blockers) or statins. The compositions of the invention may improve the patient's response to the secondary active agent.

In certain embodiments, the compositions of the invention reduce the effect of ischemia on tissues. In certain embodiments, the compositions of the invention reduce the amount of damage to tissues caused by ischemia. In certain embodiments, the tissues damaged by ischemia are the cerebral tissues. In certain embodiments, the compositions of the invention reduce necrosis or the number of necrotic cells. In certain embodiments, the compositions of the invention reduce apoptosis or the number of apoptotic cells. In certain embodiments, the compositions of the invention reduce the number of necrotic and apoptotic cells. In certain embodiments, the compositions of the invention prevent cell death by necrosis and/or apoptosis. In certain embodiments, the compositions of the invention prevent cell death by necrosis and/or apoptosis caused by ischemia. In certain embodiments, the compositions of the invention improve the recovery of the tissue damaged by ischemia. In certain embodiments, the compositions of the invention improve the speed of clearance of necrotic cells and/or apoptotic cells. In certain embodiments, the compositions of the invention improve the efficacy of the clearance of necrotic cells and/or apoptotic cells. In certain embodiments, the compositions of the invention improve the replacement and/or regeneration of cells within tissues. In certain embodiments, the compositions of the invention improve the replacement and/or regeneration of cells within tissues damaged by ischemia. In certain embodiments, the compositions of the invention improve the overall histology of the tissue (for example upon a biopsy).

Modes of Administration

Preferably, the compositions of the invention are to be administered to the gastrointestinal tract in order to enable delivery to and/or partial or total colonisation of the intestine with the bacterial strain of the invention. Generally, the compositions of the invention are administered orally, but they may be administered rectally, intranasally, or via buccal or sublingual routes.

In certain embodiments, the compositions of the invention may be administered as a foam, as a spray or a gel.

In certain embodiments, the compositions of the invention may be administered as a suppository, such as a rectal suppository, for example in the form of a theobroma oil (cocoa butter), synthetic hard fat (e.g. suppocire, witepsol), glycero-gelatin, polyethylene glycol, or soap glycerin composition.

In certain embodiments, the composition of the invention is administered to the gastrointestinal tract via a tube, such as a nasogastric tube, orogastric tube, gastric tube, jejunostomy tube (J tube), percutaneous endoscopic gastrostomy (PEG), or a port, such as a chest wall port that provides access to the stomach, jejunum and other suitable access ports.

The compositions of the invention may be administered once, or they may be administered sequentially as part of a treatment regimen. In certain embodiments, the compositions of the invention are to be administered daily.

In certain embodiments of the invention, treatment according to the invention is accompanied by assessment of the patient's gut microbiota. Treatment may be repeated if delivery of and/or partial or total colonisation with the strain of the invention is not achieved such that efficacy is not observed, or treatment may be ceased if delivery and/or partial or total colonisation is successful and efficacy is observed.

In certain embodiments, the composition of the invention may be administered to a pregnant animal, for example a mammal such as a human in order to prevent an inflammatory or autoimmune disease developing in her child in utero and/or after it is born.

The compositions of the invention may be administered to a patient that has been diagnosed with a neurodegenerative disease, or that has been identified as being at risk of a neurodegenerative disease. The compositions may also be administered as a prophylactic measure to prevent the development of neurodegenerative disease in a healthy patient.

The compositions of the invention may be administered to a patient that has been identified as having an abnormal gut microbiota. For example, the patient may have reduced or absent colonisation by *Roseburia*, and in particular *Roseburia hominis*.

The compositions of the invention may be administered as a food product, such as a nutritional supplement.

Generally, the compositions of the invention are for the treatment of humans, although they may be used to treat animals including monogastric mammals such as poultry, pigs, cats, dogs, horses or rabbits. The compositions of the invention may be useful for enhancing the growth and performance of animals. If administered to animals, oral gavage may be used.

Compositions

Generally, the composition of the invention comprises bacteria. In preferred embodiments of the invention, the composition is formulated in freeze-dried form. For example, the composition of the invention may comprise granules or gelatin capsules, for example hard gelatin capsules, comprising a bacterial strain of the invention.

Preferably, the composition of the invention comprises lyophilised bacteria. Lyophilisation of bacteria is a well-established procedure and relevant guidance is available in, for example, references [39-41].

Alternatively, the composition of the invention may comprise a live, active bacterial culture.

In some embodiments, the bacterial strain in the composition of the invention has not been inactivated, for example, has not been heat-inactivated. In some embodiments, the bacterial strain in the composition of the invention has not been killed, for example, has not been heat-killed. In some embodiments, the bacterial strain in the composition of the invention has not been attenuated, for example, has not been heat-attenuated. For example, in some embodiments, the bacterial strain in the composition of the invention has not been killed, inactivated and/or attenuated. For example, in some embodiments, the bacterial strain in the composition of the invention is live. For example, in some embodiments, the bacterial strain in the composition of the invention is viable. For example, in some embodiments, the bacterial strain in the composition of the invention is capable of partially or totally colonising the intestine. For example, in some embodiments, the bacterial strain in the composition of the invention is viable and capable of partially or totally colonising the intestine.

In some embodiments, the composition comprises a mixture of live bacterial strains and bacterial strains that have been killed.

In preferred embodiments, the composition of the invention is encapsulated to enable delivery of the bacterial strain to the intestine. Encapsulation protects the composition from degradation until delivery at the target location through, for example, rupturing with chemical or physical stimuli such as pressure, enzymatic activity, or physical disintegration, which may be triggered by changes in pH. Any appropriate encapsulation method may be used. Exemplary encapsulation techniques include entrapment within a porous matrix, attachment or adsorption on solid carrier surfaces, self-aggregation by flocculation or with cross-linking agents, and mechanical containment behind a microporous membrane or a microcapsule. Guidance on encapsulation that may be useful for preparing compositions of the invention is available in, for example, references [42] and [43].

The composition may be administered orally and may be in the form of a tablet, capsule or powder. Encapsulated products are preferred because *Roseburia* are anaerobes. Other ingredients (such as vitamin C, for example), may be included as oxygen scavengers and prebiotic substrates to improve the delivery and/or partial or total colonisation and survival in vivo. Alternatively, the probiotic composition of the invention may be administered orally as a food or nutritional product, such as milk or whey based fermented dairy product, or as a pharmaceutical product.

The composition may be formulated as a probiotic.

A composition of the invention includes a therapeutically effective amount of a bacterial strain of the invention. A therapeutically effective amount of a bacterial strain is sufficient to exert a beneficial effect upon a patient. A therapeutically effective amount of a bacterial strain may be sufficient to result in delivery to and/or partial or total colonisation of the patient's intestine.

A suitable daily dose of the bacteria, for example for an adult human, may be from about $1 \times 10^3$ to about $1 \times 10^{11}$ colony forming units (CFU); for example, from about $1 \times 10^7$ to about $1 \times 10^{10}$ CFU; in another example from about $1 \times 10^6$ to about $1 \times 10^{10}$ CFU.

In certain embodiments, the composition contains the bacterial strain in an amount of from about $1 \times 10^6$ to about $1 \times 10^{11}$ CFU/g, respect to the weight of the composition; for example, from about $1 \times 10^8$ to about $1 \times 10^{10}$ CFU/g. The dose may be, for example, 1 g, 3 g, 5 g, and 10 g.

Typically, a probiotic, such as the composition of the invention, is optionally combined with at least one suitable prebiotic compound. A prebiotic compound is usually a non-digestible carbohydrate such as an oligo- or polysaccharide, or a sugar alcohol, which is not degraded or absorbed in the upper digestive tract. Known prebiotics include commercial products such as inulin and transgalacto-oligosaccharides.

In certain embodiments, the probiotic composition of the present invention includes a prebiotic compound in an amount of from about 1 to about 30% by weight, respect to the total weight composition, (e.g. from 5 to 20% by weight). Carbohydrates may be selected from the group consisting of: fructo-oligosaccharides (or FOS), short-chain fructo-oligosaccharides, inulin, isomalt-oligosaccharides, pectins, xylo-oligosaccharides (or XOS), chitosan-oligosaccharides (or COS), beta-glucans, arable gum modified and resistant starches, polydextrose, D-tagatose, acacia fibers, carob, oats, and citrus fibers. In one aspect, the prebiotics are the short-chain fructo-oligosaccharides (for simplicity shown herein below as FOSs-c.c); said FOSs-c.c. are not digestible carbohydrates, generally obtained by the conversion of the beet sugar and including a saccharose molecule to which three glucose molecules are bonded.

In certain embodiments, the compositions of the invention are used in combination with another therapeutic compound for treating or preventing the neurodegenerative disorder. In some embodiments, the compositions of the invention are administered with nutritional supplements that modulate neuroprotection or neuroproliferation. In preferred embodiments, the nutritional supplements comprise or consist of nutritional vitamins. In certain embodiments, the vitamins are vitamin B6, magnesium, dimethylglycine (vitamin B16) and vitamin C. In certain embodiments, the compositions of the invention are administered in combination with another probiotic.

In certain embodiments, the compositions of the invention are for use in enhancing the effect of a second agent on a neurodegenerative disease. The immune modulatory effects of the compositions of the invention may make the brain more susceptible to conventional therapies such as Levodopa, dopamine agonists, MAO-B inhibitors, COMT inhibitors, Glutamate antagonists, or anticholinergics, which are exemplary secondary agents to be administered in combination (sequentially or contemporaneously) with the compositions of the invention.

The compositions of the invention may comprise pharmaceutically acceptable excipients or carriers. Examples of such suitable excipients may be found in the reference [44]. Acceptable carriers or diluents for therapeutic use are well known in the pharmaceutical art and are described, for example, in reference [45]. Examples of suitable carriers include lactose, starch, glucose, methyl cellulose, magnesium stearate, mannitol, sorbitol and the like. Examples of suitable diluents include ethanol, glycerol and water. The choice of pharmaceutical carrier, excipient or diluent can be selected with regard to the intended route of administration and standard pharmaceutical practice. The pharmaceutical compositions may comprise as, or in addition to, the carrier, excipient or diluent any suitable binder(s), lubricant(s), suspending agent(s), coating agent(s), solubilising agent(s). Examples of suitable binders include starch, gelatin, natural sugars such as glucose, anhydrous lactose, free-flow lactose, beta-lactose, corn sweeteners, natural and synthetic gums, such as acacia, tragacanth or sodium alginate, carboxymethyl cellulose and polyethylene glycol. Examples of suitable lubricants include sodium oleate, sodium stearate, magnesium stearate, sodium benzoate, sodium acetate, sodium chloride and the like. Preservatives, stabilizers, dyes and even flavouring agents may be provided in the pharmaceutical composition. Examples of preservatives include sodium benzoate, sorbic acid and esters of p-hydroxybenzoic acid. Antioxidants and suspending agents may be also used.

The compositions of the invention may be formulated as a food product. For example, a food product may provide nutritional benefit in addition to the therapeutic effect of the invention, such as in a nutritional supplement. Similarly, a food product may be formulated to enhance the taste of the composition of the invention or to make the composition more attractive to consume by being more similar to a common food item, rather than to a pharmaceutical composition. In certain embodiments, the composition of the invention is formulated as a milk-based product. The term "milk-based product" means any liquid or semi-solid milk- or whey-based product having a varying fat content. The milk-based product can be, e.g., cow's milk, goat's milk, sheep's milk, skimmed milk, whole milk, milk recombined from powdered milk and whey without any processing, or a processed product, such as yoghurt, curdled milk, curd, sour milk, sour whole milk, butter milk and other sour milk products. Another important group includes milk beverages, such as whey beverages, fermented milks, condensed milks, infant or baby milks; flavoured milks, ice cream; milk-containing food such as sweets.

In some embodiments, the compositions of the invention comprise one or more bacterial strains of the genus *Roseburia* and do not contain bacteria from any other genera, or which comprise only *de minimis* or biologically irrelevant amounts of bacteria from another genera. Thus, in some embodiments, the invention provides a composition comprising one or more bacterial strains of the genus *Roseburia*, which does not contain bacteria from any other genera or which comprises only *de minimis* or biologically irrelevant amounts of bacteria from another genera, for use in therapy.

In some embodiments, the compositions of the invention comprise one or more bacterial strains of the species *Roseburia hominis* and do not contain bacteria from any other species, or which comprise only *de minimis* or biologically irrelevant amounts of bacteria from another species. Thus, in some embodiments, the invention provides a composition comprising one or more bacterial strains of the species *Roseburia hominis*, which does not contain bacteria from any other species or which comprises only *de minimis* or biologically irrelevant amounts of bacteria from another species, for use in therapy.

In some embodiments, the compositions of the invention comprise one or more bacterial strains of the species *Roseburia intestinalis* and do not contain bacteria from any other species, or which comprise only *de minimis* or biologically irrelevant amounts of bacteria from another species. Thus, in some embodiments, the invention provides a composition comprising one or more bacterial strains of the species *Roseburia intestinalis*, which does not contain bacteria from any other species or which comprises only *de minimis* or biologically irrelevant amounts of bacteria from another species, for use in therapy.

In some embodiments, the compositions of the invention comprise one or more bacterial strains of the species *Roseburia faecis* and do not contain bacteria from any other species, or which comprise only *de minimis* or biologically irrelevant amounts of bacteria from another species. Thus, in some embodiments, the invention provides a composition comprising one or more bacterial strains of the species *Roseburia faecis*, which does not contain bacteria from any other species or which comprises only *de minimis* or biologically irrelevant amounts of bacteria from another species, for use in therapy.

In some embodiments, the compositions of the invention comprise one or more bacterial strains of the species *Roseburia hominis* and do not contain bacteria from any other *Roseburia* species, or which comprise only *de minimis* or biologically irrelevant amounts of bacteria from another *Roseburia* species. Thus, in some embodiments, the invention provides a composition comprising one or more bacterial strains of the species *Roseburia hominis*, which does not contain bacteria from any other *Roseburia* species or which comprises only *de minimis* or biologically irrelevant amounts of bacteria from another *Roseburia* species, for use in therapy.

In some embodiments, the compositions of the invention comprise one or more bacterial strains of the species *Roseburia intestinalis* and do not contain bacteria from any other *Roseburia* species, or which comprise only *de minimis* or biologically irrelevant amounts of bacteria from another *Roseburia* species. Thus, in some embodiments, the invention provides a composition comprising one or more bacterial strains of the species *Roseburia intestinalis*, which does not contain bacteria from any other *Roseburia* species or which comprises only *de minimis* or biologically irrelevant amounts of bacteria from another *Roseburia* species, for use in therapy.

In some embodiments, the compositions of the invention comprise one or more bacterial strains of the species *Roseburia faecis* and do not contain bacteria from any other *Roseburia* species, or which comprise only *de minimis* or biologically irrelevant amounts of bacteria from another *Roseburia* species. Thus, in some embodiments, the invention provides a composition comprising one or more bacterial strains of the species *Roseburia faecis*, which does not contain bacteria from any other *Roseburia* species or which comprises only *de minimis* or biologically irrelevant amounts of bacteria from another *Roseburia* species, for use in therapy.

In certain embodiments, the compositions of the invention contain a single bacterial strain or species and do not contain any other bacterial strains or species. Such compositions may comprise only *de minimis* or biologically irrelevant amounts of other bacterial strains or species. Such compositions may be a culture that is substantially free from other species of organism.

In some embodiments, the invention provides a composition comprising a single bacterial strain of the genus *Roseburia*, which does not contain bacteria from any other strains or which comprises only *de minimis* or biologically irrelevant amounts of bacteria from another strain for use in therapy.

In some embodiments, the invention provides a composition comprising a single bacterial strain of the species *Roseburia hominis*, which does not contain bacteria from any other strains or which comprises only *de minimis* or biologically irrelevant amounts of bacteria from another strain for use in therapy.

In some embodiments, the invention provides a composition comprising a single bacterial strain of the species *Roseburia intestinalis*, which does not contain bacteria from any other strains or which comprises only *de minimis* or biologically irrelevant amounts of bacteria from another strain for use in therapy.

In some embodiments, the invention provides a composition comprising a single bacterial strain of the species *Roseburia faecis*, which does not contain bacteria from any other strains or which comprises only *de minimis* or biologically irrelevant amounts of bacteria from another strain for use in therapy.

In some embodiments, the compositions of the invention comprise more than one bacterial strain. For example, in some embodiments, the compositions of the invention comprise more than one strain from within the same species (e.g. more than 1, 2, 3, 4, 5, 6, 7, 8, 9, 10, 15, 20, 25, 30, 35, 40 or 45 strains), and, optionally, do not contain bacteria from any other species. In some embodiments, the compositions of the invention comprise less than 50 strains from within the same species (e.g. less than 45, 40, 35, 30, 25, 20, 15, 12, 10, 9, 8, 7, 6, 5, 4 or 3 strains), and, optionally, do not contain bacteria from any other species. In some embodiments, the compositions of the invention comprise 1-40, 1-30, 1-20, 1-19, 1-18, 1-15, 1-10, 1-9, 1-8, 1-7, 1-6, 1-5, 1-4, 1-3, 1-2, 2-50, 2-40, 2-30, 2-20, 2-15, 2-10, 2-5, 6-30, 6-15, 16-25, or 31-50 strains from within the same species and, optionally, do not contain bacteria from any other species. The invention comprises any combination of the foregoing.

In some embodiments, the composition comprises a microbial consortium. For example, in some embodiments, the composition comprises the *Roseburia* bacterial strain as part of a microbial consortium. For example, in some embodiments, the *Roseburia* bacterial strain is present in combination with one or more (e.g. at least 2, 3, 4, 5, 10, 15 or 20) other bacterial strains from other genera with which it can live symbiotically in vivo in the intestine. For example, in some embodiments, the composition comprises a bacterial strain of *Roseburia* in combination with a bacterial strain from a different genus. In some embodiments, the microbial consortium comprises two or more bacterial strains obtained from a faeces sample of a single organism, e.g. a human. In some embodiments, the microbial consortium is not found together in nature. For example, in some embodiments, the microbial consortium comprises bacterial strains obtained from faeces samples of at least two different organisms. In some embodiments, the two different organisms are from the same species, e.g. two different humans. In some embodiments, the two different organisms are an infant human and an adult human. In some embodiments, the two different organisms are a human and a non-human mammal.

In some embodiments, the composition of the invention additionally comprises a bacterial strain that has the same safety and therapeutic efficacy characteristics as strain MRx0001, but which is not MRx0001, or which is not a *Roseburia hominis*.

In some embodiments, the composition of the invention additionally comprises a bacterial strain that has the same safety and therapeutic efficacy characteristics as strain A, but which is not strain A, or which is not a *Roseburia intestinalis*.

In some embodiments in which the composition of the invention comprises more than one bacterial strain, species or genus, the individual bacterial strains, species or genera may be for separate, simultaneous or sequential administration. For example, the composition may comprise all of the more than one bacterial strain, species or genera, or the bacterial strains, species or genera may be stored separately and be administered separately, simultaneously or sequentially. In some embodiments, the more than one bacterial strains, species or genera are stored separately but are mixed together prior to use.

In some embodiments, the bacterial strain for use in the invention is obtained from human adult faeces. In some embodiments in which the composition of the invention comprises more than one bacterial strain, all of the bacterial strains are obtained from human adult faeces or if other bacterial strains are present they are present only in *de minimis* amounts. The bacteria may have been cultured subsequent to being obtained from the human adult faeces and being used in a composition of the invention.

In some embodiments, the bacterial strain for use in the invention is obtained from human infant faeces. In some embodiments in which the composition of the invention comprises more than one bacterial strain, all of the bacterial strains are obtained from human infant faeces or if other bacterial strains are present they are present only in *de minimis* amounts. The bacteria may have been cultured subsequent to being obtained from the human infant faeces and being used in a composition of the invention.

As mentioned above, in some embodiments, the one or more *Roseburia* bacterial strains is/are the only therapeutically active agent(s) in a composition of the invention. In some embodiments, the bacterial strain(s) in the composition is/are the only therapeutically active agent(s) in a composition of the invention.

The compositions for use in accordance with the invention may or may not require marketing approval.

In certain embodiments, the invention provides the above pharmaceutical composition, wherein said bacterial strain is lyophilised. In certain embodiments, the invention provides the above pharmaceutical composition, wherein said bacterial strain is spray dried. In certain embodiments, the invention provides the above pharmaceutical composition, wherein the bacterial strain is lyophilised or spray dried and wherein it is live. In certain embodiments, the invention provides the above pharmaceutical composition, wherein the bacterial strain is lyophilised or spray dried and wherein it is viable. In certain embodiments, the invention provides the above pharmaceutical composition, wherein the bacterial strain is lyophilised or spray dried and wherein it is capable of partially or totally colonising the intestine. In certain embodiments, the invention provides the above pharmaceutical composition, wherein the bacterial strain is lyophilised or spray dried and wherein it is viable and capable of partially or totally colonising the intestine.

In some cases, the lyophilised bacterial strain is reconstituted prior to administration. In some cases, the reconstitution is by use of a diluent described herein.

The compositions of the invention can comprise pharmaceutically acceptable excipients, diluents or carriers.

In certain embodiments, the invention provides a pharmaceutical composition comprising: a bacterial strain of the invention; and a pharmaceutically acceptable excipient, carrier or diluent; wherein the bacterial strain is in an amount sufficient to treat a neurodegenerative disorder when administered to a subject in need thereof.

In certain embodiments, the invention provides pharmaceutical composition comprising: a bacterial strain of the invention; and a pharmaceutically acceptable excipient, carrier or diluent; wherein the bacterial strain is in an amount sufficient to treat or prevent a neurodegenerative disorder.

In certain embodiments, the invention provides the above pharmaceutical composition, wherein the amount of the bacterial strain is from about $1\times10^3$ to about $1\times10^{11}$ colony forming units per gram with respect to a weight of the composition.

In certain embodiments, the invention provides the above pharmaceutical composition, wherein the composition is administered at a dose of 1 g, 3 g, 5 g or 10 g.

In certain embodiments, the invention provides the above pharmaceutical composition, wherein the composition is administered by a method selected from the group consisting of oral, rectal, subcutaneous, nasal, buccal, and sublingual.

In certain embodiments, the invention provides the above pharmaceutical composition, comprising a carrier selected from the group consisting of lactose, starch, glucose, methyl cellulose, magnesium stearate, mannitol and sorbitol.

In certain embodiments, the invention provides the above pharmaceutical composition, comprising a diluent selected from the group consisting of ethanol, glycerol and water.

In certain embodiments, the invention provides the above pharmaceutical composition, comprising an excipient selected from the group consisting of starch, gelatin, glucose, anhydrous lactose, free-flow lactose, beta-lactose, corn sweetener, acacia, tragacanth, sodium alginate, carboxymethyl cellulose, polyethylene glycol, sodium oleate, sodium stearate, magnesium stearate, sodium benzoate, sodium acetate and sodium chloride.

In certain embodiments, the invention provides the above pharmaceutical composition, further comprising at least one of a preservative, an antioxidant and a stabilizer.

In certain embodiments, the invention provides the above pharmaceutical composition, comprising a preservative selected from the group consisting of sodium benzoate, sorbic acid and esters of p-hydroxybenzoic acid.

In certain embodiments, the invention provides the above pharmaceutical composition, wherein said bacterial strain is lyophilised.

In certain embodiments, the invention provides the above pharmaceutical composition, wherein when the composition is stored in a sealed container at about 4.0 or about 25.0 and the container is placed in an atmosphere having 50% relative humidity, at least 80% of the bacterial strain as measured in colony forming units, remains after a period of at least about: 1 month, 3 months, 6 months, 1 year, 1.5 years, 2 years, 2.5 years or 3 years.

In some embodiments, the composition of the invention is provided in a sealed container comprising a composition as described herein. In some embodiments, the sealed container is a sachet or bottle. In some embodiments, the composition of the invention is provided in a syringe comprising a composition as described herein.

The composition of the present invention may, in some embodiments, be provided as a pharmaceutical formulation. For example, the composition may be provided as a tablet or capsule. In some embodiments, the capsule is a gelatine capsule ("gel-cap").

In some embodiments, the compositions of the invention are administered orally. Oral administration may involve swallowing, so that the compound enters the gastrointestinal tract, and/or buccal, lingual, or sublingual administration by which the compound enters the blood stream directly from the mouth.

Pharmaceutical formulations suitable for oral administration include solid plugs, solid microparticulates, semi-solid and liquid (including multiple phases or dispersed systems) such as tablets; soft or hard capsules containing multi- or nano-particulates, liquids (e.g. aqueous solutions), emulsions or powders; lozenges (including liquid-filled); chews; gels; fast dispersing dosage forms; films; ovules; sprays; and buccal/mucoadhesive patches.

In some embodiments the pharmaceutical formulation is an enteric formulation, i.e. a gastro-resistant formulation (for example, resistant to gastric pH) that is suitable for delivery of the composition of the invention to the intestine by oral administration. Enteric formulations may be particularly useful when the bacteria or another component of the composition is acid-sensitive, e.g. prone to degradation under gastric conditions.

In some embodiments, the enteric formulation comprises an enteric coating. In some embodiments, the formulation is an enteric-coated dosage form. For example, the formulation may be an enteric-coated tablet or an enteric-coated capsule, or the like. The enteric coating may be a conventional enteric coating, for example, a conventional coating for a tablet, capsule, or the like for oral delivery. The formulation may comprise a film coating, for example, a thin film layer of an enteric polymer, e.g. an acid-insoluble polymer.

In some embodiments, the enteric formulation is intrinsically enteric, for example, gastro-resistant without the need for an enteric coating. Thus, in some embodiments, the formulation is an enteric formulation that does not comprise an enteric coating. In some embodiments, the formulation is a capsule made from a thermogelling material. In some embodiments, the thermogelling material is a cellulosic material, such as methylcellulose, hydroxymethylcellulose or hydroxypropylmethylcellulose (HPMC). In some embodiments, the capsule comprises a shell that does not contain any film forming polymer. In some embodiments, the capsule comprises a shell and the shell comprises hydroxypropylmethylcellulose and does not comprise any film forming polymer (e.g. see [46]). In some embodiments, the formulation is an intrinsically enteric capsule (for example, Vcaps® from Capsugel).

In some embodiments, the formulation is a soft capsule. Soft capsules are capsules which may, owing to additions of softeners, such as, for example, glycerol, sorbitol, maltitol and polyethylene glycols, present in the capsule shell, have a certain elasticity and softness. Soft capsules can be produced, for example, on the basis of gelatine or starch. Gelatine-based soft capsules are commercially available from various suppliers. Depending on the method of administration, such as, for example, orally or rectally, soft capsules can have various shapes, they can be, for example, round, oval, oblong or torpedo-shaped. Soft capsules can be produced by conventional processes, such as, for example, by the Scherer process, the Accogel process or the droplet or blowing process.

Culturing Methods

The bacterial strains for use in the present invention can be cultured using standard microbiology techniques as detailed in, for example, references [47-49].

The solid or liquid medium used for culture may be YCFA agar or YCFA medium. YCFA medium may include (per 100 ml, approximate values): Casitone (1.0 g), yeast extract (0.25 g), NaHCO$_3$ (0.4 g), cysteine (0.1 g), K$_2$HPO$_4$ (0.045 g), KH$_2$PO$_4$ (0.045 g), NaCl (0.09 g), (NH$_4$)$_2$SO$_4$ (0.09 g), MgSO$_4$.7H$_2$O (0.009 g), CaCl$_2$ (0.009 g), resazurin (0.1 mg), hemin (1 mg), biotin (1 µg), cobalamin (1 µg), p-aminobenzoic acid (3 µg), folic acid (5 µg), and pyridoxamine (15 µg).

Bacterial Strains for Use in Vaccine Compositions

The inventors have identified that the bacterial strains of the invention are useful for treating or preventing neurodegenerative disorders. This is likely to be a result of the effect that the bacterial strains of the invention have on the host immune system. Therefore, the compositions of the invention may also be useful for preventing neurodegenerative disorders, when administered as vaccine compositions. In certain such embodiments, the bacterial strains of the invention may be killed, inactivated or attenuated. In certain such embodiments, the compositions may comprise a vaccine adjuvant. In certain embodiments, the compositions are for administration via injection, such as via subcutaneous injection.

General

The practice of the present invention will employ, unless otherwise indicated, conventional methods of chemistry, biochemistry, molecular biology, immunology and pharmacology, within the skill of the art. Such techniques are explained fully in the literature. See, e.g., references [50] and [51-57], etc.

The term "comprising" encompasses "including" as well as "consisting" e.g. a composition "comprising" X may consist exclusively of X or may include something additional e.g. X+Y.

The term "about" in relation to a numerical value x is optional and means, for example, x±10%.

The word "substantially" does not exclude "completely" e.g. a composition which is "substantially free" from Y may be completely free from Y. Where necessary, the word "substantially" may be omitted from the definition of the invention.

References to a percentage sequence identity between two nucleotide sequences means that, when aligned, that percentage of nucleotides are the same in comparing the two sequences. This alignment and the percent homology or sequence identity can be determined using software programs known in the art, for example those described in section 7.7.18 of ref [58]. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref. [59].

Unless specifically stated, a process or method comprising numerous steps may comprise additional steps at the beginning or end of the method, or may comprise additional intervening steps. Also, steps may be combined, omitted or performed in an alternative order, if appropriate.

Various embodiments of the invention are described herein. It will be appreciated that the features specified in each embodiment may be combined with other specified features, to provide further embodiments. In particular, embodiments highlighted herein as being suitable, typical or preferred may be combined with each other (except when they are mutually exclusive).

MODES FOR CARRYING OUT THE INVENTION

Example 1—Efficacy of Bacterial Inocula to Reduce IL-6 Secretion

Summary

Activation of proinflammatory cytokines has been associated with neuron damage in neurodegenerative disease. Lipopolysaccharide (LPS) is a known stimulator of the proinflammatory cytokine IL-6. Human glioblastoma astrocytoma cells were treated with compositions comprising bacterial strains according to the invention in combination with LPS to observe their ability to modulate the levels of IL-6.

Material and Methods

Bacterial Strain

*Roseburia hominis* MRx0001

Cell Line

MG U373 is a human glioblastoma astrocytoma derived from a malignant tumour and were purchased from Sigma-Aldrich (cat n. 08061901-1VL). MG U373 human glioblastoma astrocytoma cells were grown in MEM (Sigma Aldrich, cat n. M-2279) supplemented with 10% FBS, 1% Pen Strep, 4 mM L-Glut, 1×MEM Non essential Amino Acid solution and 1× Sodium Piruvate.

Method

Once grown the MG U373 cells were plated on 24-well plate at 100,000 cells/well. The cells were treated with LPS (1 ug/mL) alone or with 10% of bacteria supernatant from MRx0001 for 24h. A control was also performed where the cells were incubated in untreated media. The cells were treated with 10% of bacteria supernatant from MRx0001 or YCFA alone for 24h. A control was also performed where the cells were incubated in untreated media. Afterwards the cell free supernatants were collected, centrifuged at 10,000 g for 3 min at 4° C. IL-6 was measured using the Human IL-6 ELISA Kit from Peprotech (cat n.#900-K16) according to manufacturer instruction.

Results

The results of these experiments are shown in FIG. 1 and FIG. 9. Treatment of neuroblastoma cells with LPS and the bacteria strain led to a decrease in the level of IL-6 secreted to the same level as the control cells that were untreated with LPS (FIG. 1). Treatment of neuroblastoma cells with *Roseburia hominis* led to a decrease in the level of IL-6 secreted below the levels observed with the cells treated with the control (FIG. 9).

Example 2—Efficacy of Bacterial Inocula to Reduce NFκB Activation

Summary

Activation of the NFκB promoter leads to the production of proinflammatory cytokines including IL-1β, IL-1α, IL-18, TNFα and IL-6. The NFκB promoter can be activated by α-synuclein and LPS by stimulating the TLR4 ligand. Mutations in α-synuclein, such as α-synuclein A53T, are implicated in familial Parkinson's. Treatment of neuronal cells with LPS simulates Parkinson's caused by environmental factors. The ability of compositions comprising bacterial strains according to the invention to inhibit the activation of the NFκB promoter was investigated.

Material and Methods

Bacterial Strain

*Roseburia hominis* MRx0001

Cell Line

Human Hek blue TLR4 were purchased from InvivoGen (cat n. hkb-htlr4). Human Hek blue TLR4 were grown in DMEM high glucose (Sigma Aldrich, cat n. D-6171) supplemented with 10% FBS, 1% Pen Strep, 4 mM L-Glut, Normocin and 1×FMK Blue selection solution.

Method

Once grown the Human Hek blue cells were plated in 96 well plate at 25,000 cells/well in 4 replicates. One set of cells were treated with α-synuclein A53T (1 ug/mL) alone or with 10% of bacteria supernatant from MRx0001 for 22h. The second set of cells were treated with LPS (10 ng/mL, from *Salmonella enterica* serotype *Typhimurium*, Sigma Aldrich, cat n. L6143) alone or with 10% of bacteria supernatant from MRx0001 for 22h. The cells were subsequently spun down and 20 ul of the supernatant was mixed with 200 ul of Quanti Blue reagent (InvivoGen, cat n. rep-qb2), incubated for 2 h and absorbance read at 655 nm.

Results

The results of these experiments are shown in FIGS. 2 and 3. FIG. 2 shows that the activation of the NFκB promoter by α-synuclein is inhibited by MRx0001. FIG. 3 shows that the activation of the NFκB promoter by LPS is inhibited by MRx0001.

Example 3—Efficacy of Bacterial Inocula to Alter Antioxidant Capacity

Summary

The ability of compositions comprising bacterial strains according to the invention to alter the antioxidant capacity. The antioxidant capacity of the bacterial strain was established using the well-known ABTS (2,2'-azino-bis(3-ethyl-benzothiazoline-6-sulphonic acid)) assay.

Bacterial Strain

*Roseburia hominis* MRx0001

Method

Bacterial cells ($10^6$ or greater) were collected and centrifuged. They were resuspended in assay buffer (using three times the pellet volume). The suspension was sonicated on ice for 5 minutes and then spun down at 12,000×g for 10 minutes. The supernatant was removed and measured using the ABTS assay kit produced by Sigma Aldrich (code CS0790), in accordance with manufacturer's instructions.

Results

The results of these experiments are shown in FIG. 4. FIG. 4 shows that MRx0001 has an antioxidant capacity of approximately 1 mM compared to Trolox.

Example 4—Efficacy of Bacterial Inocula to Alter Lipid Peroxidation Levels

Summary

The ability of compositions comprising bacterial strains according to the invention to alter lipid peroxidation levels was investigated. The thiobarbituric reactive substances assay (TBARs) was used to measure the by-products of lipid peroxidation.

Material and Methods

Bacterial Strain

*Roseburia hominis* MRx0001

Method

Bacterial cells ($10^6$ or greater) were collected and centrifuged, a wash step was performed with isotonic saline before the pellet was re-suspended in potassium chloride assay buffer. The suspension was sonicated on ice for 10 minutes and then spun down at 10,000×g for 10 minutes. The supernatant was removed and the level of lipid peroxidation evaluated using the thiobarbituric reactive substances assay.

Results

The results of the experiments are shown in FIG. 5. FIG. 5 shows that MRx0001 is able to inhibit lipid peroxidation by approximately 18%, which is a higher antioxidant capacity than the positive control, butylated hydroxytoluene (1% w/v).

Example 5—Efficacy of Bacterial Inocula on Histone Deacetylatase Activity

Summary

The ability of compositions comprising bacterial strains according to the invention to alter histone deacetylatase activity was investigated. Dysregulation of histone deacetylatase has been implicated in the pathogenesis associated with age-associated neurodegenerative diseases.

Material and Methods

Bacterial Strain

*Roseburia hominis* MRx0001

Cell Line

The cell line HT-29 was used because histone deacetylase is present.

Method

Cell free supernatants of stationary phase bacterial cultures were isolated by centrifugation and filtering in a 0.22 uM filter. HT-29 cells were used 3 days' post confluence and stepped down in 1 mL DTS 24 hours prior to commencement of the experiment. The HT-29 cells were challenged with 10% cell free supernatant diluted in DTS and this was left to incubate for 48 hours. Nuclease proteins were then extracted using the Sigma Aldrich Nuclease extraction kit and samples were snap frozen prior to HDAC activity measurement. HDAC activity was assessed fluorometrically using the Sigma Aldrich (UK) kit.

Results

The results of the experiments are shown in FIG. 6. FIG. 6 shows that MRx0001 is able reduce the levels of histone deacetylase activity.

Example 6—Level of Indole Production in Bacteria

Summary

The ability of the bacteria of the invention to produce indole was investigated. Indole has been implicated in attenuating inflammation and oxidative stress.

Material and Methods

Bacterial Strain

*Roseburia hominis* MRx0001

ATCC 11775 is a bacterial reference strain that is known to produce indole.

Method

Intact bacterial cells in stationary phase were incubated with 6 mM Tryptophan for 48 hours. Bacterial species which possess the enzyme tryptophanase will utilise tryptophan as a substrate to produce indole. Following the 48 hour incubation period, the supernatant was removed and added to Kovac's reagent for quantification of indole. Standards, stock solutions and reagents were prepared using standardised methods validated in-house.

Results

The results of the experiments are shown in FIG. 7. FIG. 7 shows that MRx0001 has the capacity to produce indole from tryptophan, at concentrations of approximately 0.25 mM.

Example 7—Level of Kynurenine Production in Bacteria

Summary

The ability of the bacteria of the invention to produce kynurenine was investigated. Dysregulation of the kynurenine pathway can lead to activation of the immune system and the accumulation of potentially neurotoxic compounds. Alterations in the kynurenine metabolism may be involved in the development of Parkinson's diseases.

Bacterial Strain
*Roseburia hominis* MRx0001
DSM 17136 is a strain of *Bacteroides copricola* that is known to produce kynurenine.
Method
Cell free supernatants of stationary phase bacterial cultures were isolated by centrifugation and filtering in a 0.22 uM filter and frozen until use. Kynurenine standards, stock solutions and reagents were prepared using standardised methods validated in-house. Sample were treated with trichloroacetic acid and centrifuged at 10,000×g for 10 minutes at 4° C. The supernatant was collected and dispensed into a 96 well plate. Ehrlich's reagent was used for kynurenine detection and added at a ratio of 1:1.
Results
The results of the experiments are shown in FIG. 8. FIG. 8 shows that MRx0001 has the capacity to produce kynurenine at a concentration of approximately 50 μM.

Example 8—Stability Testing

A composition described herein containing at least one bacterial strain described herein is stored in a sealed container at 25° C. or 4° C. and the container is placed in an atmosphere having 30%, 40%, 50%, 60%, 70%, 75%, 80%, 90% or 95% relative humidity. After 1 month, 2 months, 3 months, 6 months, 1 year, 1.5 years, 2 years, 2.5 years or 3 years, at least 50%, 60%, 70%, 80% or 90% of the bacterial strain shall remain as measured in colony forming units determined by standard protocols.

Example 9—Efficacy of Bacterial Inocula to Reduce IL-6 Secretion

Figure 10A:
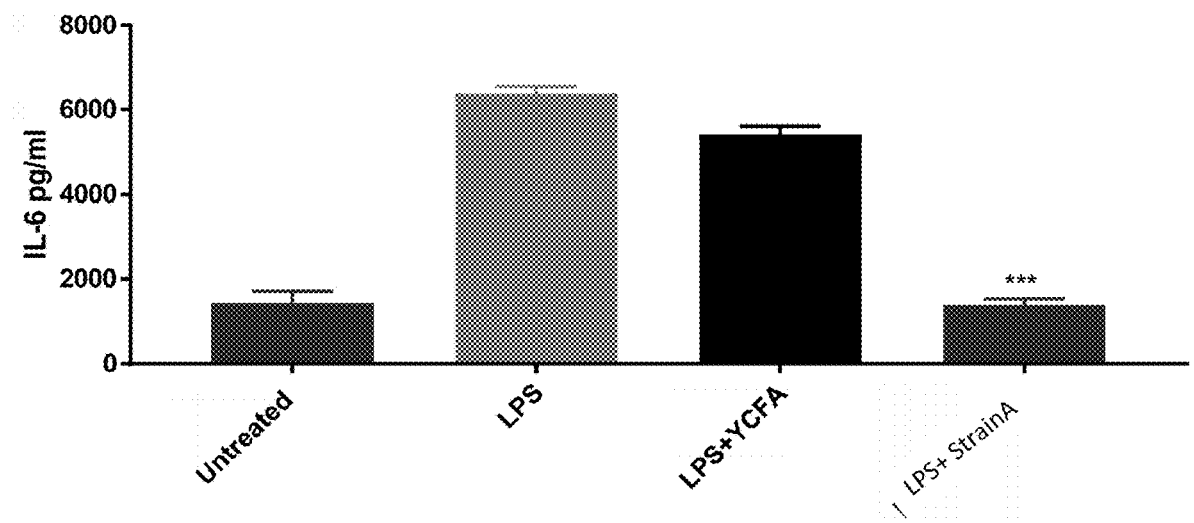
FIGS. 10A-10B: Downregulation of IL-6 secretion by strain A: Inhibition of IL-6 secretion in U373 (FIG. 10A); Inhibition of IL-6 secretion in U373 (FIG. 10B)
Figure 10B:
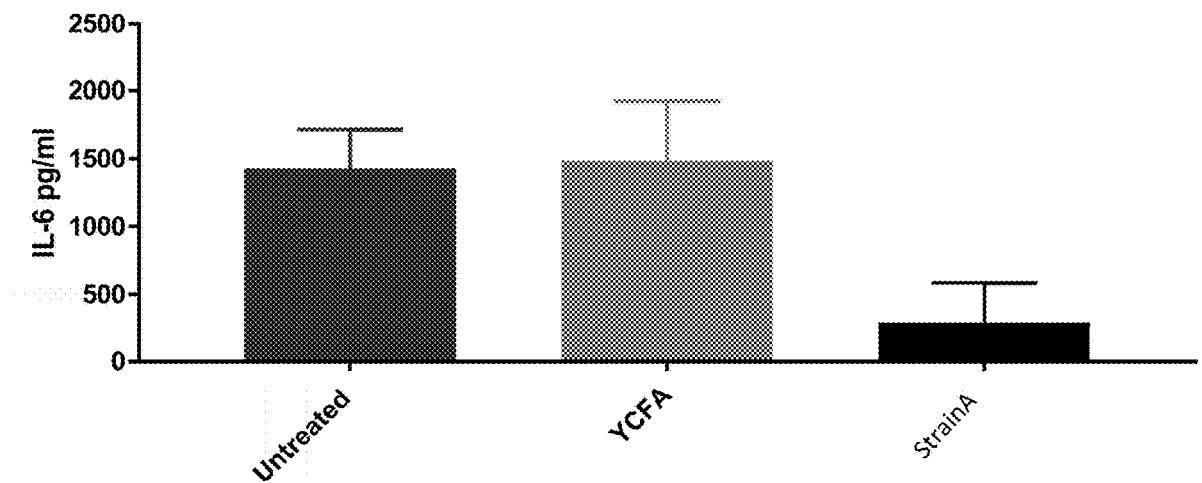

Summary
Activation of proinflammatory cytokines has been associated with neuron damage in neurodegenerative disease. Lipopolysaccharide (LPS) is a known stimulator of the proinflammatory cytokine IL-6. Human glioblastoma astrocytoma cells were treated with compositions comprising bacterial strains according to the invention in combination with LPS to observe their ability to modulate the levels of IL-6.
Material and Methods
Bacterial Strain
*Roseburia intestinalis* Strain A
*Roseburia faecis* Strain B
Cell Line
MG U373 is a human glioblastoma astrocytoma derived from a malignant tumour and were purchased from Sigma-Aldrich (cat n. 08061901-1VL). MG U373 human glioblastoma astrocytoma cells were grown in MEM (Sigma Aldrich, cat n. M-2279) supplemented with 10% FBS, 1% Pen Strep, 4 mM L-Glut, 1×MEM Non essential Amino Acid solution and 1× Sodium Piruvate.
Method
Once grown the MG U373 cells were plated on 24-well plate at 100,000 cells/well. The cells were treated with the following conditions for 24h:
LPS (1 ug/mL)
LPS with 10% of bacteria supernatant from Strain A
LPS with 10% of bacteria supernatant from Strain B
LPS with YCFA media
YCFA
A control was also performed where the cells were incubated in untreated media.
Afterwards the cell free supernatants were collected, centrifuged at 10,000 g for 3 min at 4° C. IL-6 was measured using the Human IL-6 ELISA Kit from Peprotech (cat n.#900-K16) according to manufacturer instruction.
Results
The results of these experiments are shown in FIGS. 10 and 12. Treatment of neuroblastoma cells with LPS and the bacteria strain A and B led to a decrease in the level of IL-6 secreted to the same level as the control cells that were untreated with LPS (FIGS. 10A and 12A).
Treatment of neuroblastoma cells with *Roseburia intestinalis* and *Roseburia faecis* led to a decrease in the level of IL-6 secreted below the levels observed with the cells treated with the control (FIGS. 10B and 12B).

Example 10—Efficacy of Bacterial Inocula to Reduce NFκB Activation

Summary
Activation of the NFκB promoter leads to the production of proinflammatory cytokines including IL-1β, IL-1α, IL-18, TNFα and IL-6. The NFκB promoter can be activated by α-synuclein and LPS by stimulating the TLR4 ligand. Mutations in α-synuclein, such as α-synuclein A53T, are implicated in familial Parkinson's. Treatment of neuronal cells with LPS simulates Parkinson's caused by environmental factors. The ability of compositions comprising bacterial strains according to the invention to inhibit the activation of the NFκB promoter was investigated.
Material and Methods
Bacterial Strain
*Roseburia intestinalis* Strain A
*Roseburia faecis* Strain B
Cell Line
Human Hek blue TLR4 were purchased from InvivoGen (cat n. hkb-hdr4). Human Hek blue TLR4 were grown in DMEM high glucose (Sigma Aldrich, cat n. D-6171) supplemented with 10% FBS, 1% Pen Strep, 4 mM L-Glut, Normocin and 1×HEK Blue selection solution.
Method
Once grown the Human Hek blue cells were plated in 96 well plate at 25,000 cells/well in 4 replicates. One set of cells were treated with α-synuclein A53T (1 ug/mL) alone or with 10% of bacteria supernatant from Strain A or Strain B for 22h. The second set of cells were treated with LPS (10 ng/mL, from *Salmonella enterica* serotype *Typhimurium*, Sigma Aldrich, cat n. L6143) alone or with 10% of bacteria supernatant from Strain A or Strain B for 22h. The cells were subsequently spun down and 20 ul of the supernatant was mixed with 200 ul of Quanti Blue reagent (InvivoGen, cat n. rep-qb2), incubated for 2 h and absorbance read at 655 nm.
Results
The results of these experiments are shown in FIGS. 11 and 13.

```
Sequences
(Roseburia hominis strain A2-181 16S ribosomal RNA gene, partial
sequence - AY804148)
                                                          SEQ ID NO: 1
  1 taaaggttga tcctggctca ggatgaacgc tggaggcgtg cttaacacat gcaagtcgaa 61 cgaagcactt taattgattt cttcggaatg aagtttttgt gactgagtgg cggacgggtg
```

-continued

```
 121 agtaacgcgt gggtaacctc gctcatacag ggggataaca gttggaaacg actgctaata
 181 ccgcataagc gcacaggatt gcatgatcca gtgtgaaaaa ctccggtggt atgagatgga
 241 cccgcgtctg attagccagt tggcggggta acggcccacc aaagcgacga tcagtagccg
 301 acctgagagg gtgaccggcc acattgggac tgagacacgg cccaaactcc tacgggaggc
 361 agcagtgggt aatattgcac aatggggaa accctgatgc agcgacgccg agtgagcgaa
 421 gaagtatttc ggtatgtaaa gctctatcag caggaagaag aatgacggta cctgactaaa
 481 aagcaccggc taaatacgtg ccagcagccg cggtaatacg tatggtgcaa gcgttatccg
 541 gatttactgg gtgtaaaggg agcgcaggcg gtacggcaag tctgatgtga atcccggggg
 601 ctcaaccccg gtactgcatt ggaaactgtc ggactagggt gtctgagggg taagtggaat
 661 tcctagtgta gcggtgaaat gcgtagatat taggaggaac accagtggcg aaggcggctt
 721 actggacgat tactgacgct gaggctcgaa agcgtgggga gcaaacagga ttagataccc
 781 tggtagtcca cgccgtaaac gatgaatact aggtgtcggg gagcattgct cttcggtgcc
 841 gcagcaaacg caataagtat tccacctggg gagtacgttc gcaagaatga aactcaaagg
 901 aattgacggg gacccgcaca agcggtggag catgtggttt aattcgaagc aacgcgaaga
 961 accttaccaa gtcttgacat cccactgaca aagtatgtaa tgtactttct cttcggagca
1021 gtggtgacag gtggtgcatg gttgtcgtca gctcgtgtcg tgagatgttg ggttaagtcc
1081 cgcaacgagc gcaaccccta ttcttagtag ccagcggttt ggccgggcac tctagggaga
1141 ctgccaggga taacctggag gaaggtgggg atgacgtcaa atcatcatgc cccttatgac
1201 ttgggctaca cacgtgctac aatggcgtaa acaaagggaa gcaatcccgc gaggggagc
1261 aaatctcaaa aataacgtct cagttcggac tgtagtctgc aactcgacta cacgaagctg
1321 gaatcgctag taatcgcgaa tcagaatgtc gcggtgaata cgttcccggg tcttgtacac
1381 accgcccgtc acaccatggg agttggtaat gcccgaagtc agtgacccaa ccgcaaggag
1441 ggagctgccg aagcaggact gataactggg gtgaagtcgt aacaagt
```
(Roseburia hominis A2-183 16S rRNA gene, type strain A2-183T - AJ270482)

SEQ ID NO: 2

```
   1 gatcctggct caggatgaac gctggcgcg tgcttaacac atgcaagtcg aacgaagcac
  61 tttaattgat ttcttcggaa tgaagttttt gtgactgagt ggcggacggg tgagtaacgc
 121 gtgggtaacc tgcctcatac aggggataa cagttggaaa cgactgctaa taccgcataa
 181 gcgcacagga ttgcatgatc cagtgtgaaa aactccggtg gtatgagatg acccgcgtc
 241 tgattagcca gttggcgggg taacggccca ccaaagcgac gatcagtagc cgacctgaga
 301 gggtgaccgg ccacattggg actgagacac ggcccaaact cctacgggag gcagcagtgg
 361 ggaatattgc acaatggggg aaaccctgat gcagcgacgc cgcgtgagcg aagaagtatt
 421 tcggtatgta aagctctatc agcagggaag aagaatgcgg tacctgacta agaagcaccg
 481 gctaaatacg tgccagcagc cgcggtaata cgtatggtgc aagcgttatc cggatttact
 541 gggtgtaaag ggagcgcagg cggtacggca agtctgatgt gaaatcccgg ggctcaaccc
 601 cggtactgca ttggaaactg tcggactaga gtgtcggagg ggtaagtgga attcctagtg
 661 tagcggtgaa atgcgtagat attaggagga acaccagtgg cgaaggcggc ttactggacg
 721 attactgacg ctgaggctcg aaagcgtggg gagcaaacag gattagatac cctggtagtc
 781 cacgccgtaa acgatgaata ctaggtgtcg gggagcattg ctcttcggtg ccgcagcaaa
 841 cgcaataagt attccacctg gggagtacgt tcgcaagaat gaaactcaaa ggaattgacg
 901 gggacccgca caagcggtgg agcatgtggt ttaattcgaa gcaacgcgaa gaaccttacc
```

-continued

```
 961 aagtcttgac atcccactga cagagtatgt aatgtactt tcttcggag cagtggtgac 1021 aggtggtgca tggttgtcgt cagctcgtgt cgtgagatgt tgggttaagt cccgcaacga 1081 gcgcaacccc tattcttagt agccagcggt tcggccgggc actctaggga gactgccagg 1141 gataacctgg aggaaggtgg ggatgacgtc aaatcatcat gccccttatg acttgggcta 1201 cacacgtgct acaatggcgt aaacaaaggg aagcaatccc gcgaggggga gcaaatctca 1261 aaaataacgt ctcagttcgg actgtagtct gcaactcgac tacacgaagc tggaatcgct 1321 agtaatcgcg aatcagaatg tcgcggtgaa tacgttcccg ggtcttgtac acaccgcccg 1381 tcacaccatg ggagttggta atgcccgaag tcagtgaccc aaccgcaagg agggagctgc 1441 cgaaggcagg actgataact ggggtgaagt cgtaacaagg gtacg
```

(consensus 16S rRNA sequence for *Roseburia hominis* strain 433)

SEQ ID NO: 3

```
AAGAGTTTGGGHCAGGCTCAGGATGAACGCTGGCGGCGTGCTTAACACATGCAAGTCGAACGAAGCACTTTAATTGA
TTTCTTCGGAATGAAGTTTTTGTGACTGAGTGGCGGACGGGTGAGTAACGCGTGGGTAACCTGCCTCATACAGGGGG
ATAACAGTTGGAAACGACTGCTAATACCGCATAAGCGCACAGGATTCATGATCCAGTGTGAAAAACTCCGGTGGTA
TGAGATGGACCCGCGTCTGATTAGCCAGTTGGCGGGGTAACGGCCCACCAAAGCGACGATCAGTAGCCGACCTGAGA
GGGTGACCGGCCACATTGGGACTGAGACACGGCCCAAACTCCTACGGGAGGCAGCAGTGGGGAATATTGCACAATGG
GGGAAACCCTGATGCAGCGACGCCGCGTGAGCGAAGAAGTATTTCGGTATGTAAAGCTCTATCAGCAGGGAAGAAGA
ATGACGGTACCTGACTAAGAAGCACCGGCTAAATACGTGCCAGCAGCCGCGGTAATACGTATGGTGCAAGCGTTATC
CGGATTTACTGGGTGTAAAGGGAGCGCAGGCGGTACGGCAAGTCTGATGTGAAATCCCGGGGCTCAACCCCGGTACT
GCATTGGAAACTGTCGGACTAGAGTGTCGGAGGGGTAAGTGGAATTCCTAGTGTAGCGGTGAAATGCGTAGATATTA
GGAGGAACACCAGTGGCGAAGGCGGCTTACTGGACGATTACTGACGCTGAGGCTCGAAAGCGTGGGGAGCAAACAGG
ATTAGATACCCTGGTAGTCCACGCCGTAAACGATGAATACTAGGTGTCGGGGAGCATTGCTCTTCGGTGCCGCAGCA
AACGCAATAAGTATNCCACCTGGGGAGTACGTTCGCAAGAATGAAACTCAAAGGAATTGACGGGACCCGCACAAGC
GGTGGAGCNTGTGGTTTAATTCGAAGCAACGCGAAGAACCTTACCAAGTCTTGACATCCCACTGACAGAGTATGTAA
TGTACTTTCTCTTCGGAGCAGTGGTGACAGGTGGTGCATGGTTGTCGTCAGCTCGTGTCGTGAGATGTTGGGTTAAG
TCCCGCAACGAGCGCAACCCCTATTCTTAGTAGCCAGCGGTTTGGCCGGGCACTCTAGGGAGACTGCCAGGGATAAC
CTGGAGGAAGGTGGGGATGACGTCAAATCATCATGCCCCTTATGACTTGGGCTACACACGTGCTACAATGGCGTAAA
CAAAGGGAAGCAATCCCGCGAGGGGGAGCAAATCTCAAAAATAACGTCTCAGTTCGGACTGTAGTCTGCAACTCGAC
TACACGAAGCTGGAATCGCTAGTAATCGCGAATCAGAATGTCGCGGTGAATACGTTCCCGGGTCTTGTACACACCGC
CCGTCACACCATGGGAGTTGGTAATGCCCGAAGTCAGTGACCCAACCGCAAGGAGGGAGCTGCCGAAGGCAGGACTG
ATAACTGGGGTGAAGTCTACRSAGGGTAGCCGTRMMC.
```

(Consensus 16S rRNA sequence, Strain A *Roseburia intestinalis*)

SEQ ID NO: 5

```
gctccctcct tgcggttggg tcactgactt cgggcattac caactcccat ggtgtgacgg   60
gcggtgtgta caagacccgg gaacgtattc accgcgacat tctgattcgc gattactagc  120
gattccagct tcgtgcagtc gagttgcaga ctgcagtccg aactgagacg ttattttga   180 gatttgctcc ccctcgcagg ctcgcttccc tttgtttacg ccattgtagc acgtgtgtag  240
cccaagtcat aaggggcatg atgatttgac gtcatcccca ccttcctcca ggttatccct  300
ggcagtctcc ctagagtgcc cggcttaccc gctggctact aagaataggg gttgcgctcg  360
ttgcgggact aacccaaca tctcacgaca cgagctgacg acaaccatgc accacctgtc  420
accgatgctc cgaagagaaa acacattaca tgttctgtca tcgggatgtc aagacttggt  480
aaggttcttc gcgttgcttc gaattaaacc acatgctcca ccgcttgtgc gggtcccgt   540 caattccttt gagtttcatt cttgcgaacg tactccccag gtggaatact tattgcgttt  600
```

```
gctgcggcac cgaagagcaa tgctccccga cacctagtat tcatcgttta cggcgtggac    660
tacccagggta tctaatcctg tttgctcccc acgctttcga gcctcagcgt cagtaatcgt   720
ccagtaagcc gccttcgcca ctggtgttcc tcctaatatc tacgcatttc accgctacac   780
taggaattcc acttacccct ccgacactct agtccgacag tttccaatgc agtaccgggg   840
ttgagccccg ggctttcaca tcagacttgc cgtaccgcct gcgctcccct tacacccagt   900
aaatccggat aacgcttgca ccatacgtat taccgcggct gctggcacgt atttagccgt   960
tgcttcttag tcaggtaccg tcatttcttc ttccctgnct gatagagctt tacataccga  1020
aatacttctt cgctcacgcg cgtcgctgc atcagggttt cccccattgt gcaatattcc   1080
ccactgctgc ctcccgtagg agtttgggcc gtgtctcagt cccaatgtgg ccggtcaccc   1140
tctcaggtcg gctactgatc gtcgctttgg taggccgtta ccccaccaac tggctaatca   1200
gacgcgggtc catctcatac caccggagtt tttcacacca ggtcatgcga ccctgtgcgc   1260
ttatgcggta ttagcagtcg tttccaactg ttatcccct gtatgaggca ggttaccac   1320
gcgttactca cccgtccgcc actcagtcac aaaatcttca ttccgaagaa atcaaataaa  1380
gtgcttcgtt cgactgca                                                 1398
```

(Consensus 16S rRNA sequence, Strain B *Roseburia faecis*)

SEQ ID NO: 6

```
agctccctcc ttgcggttgg gtcactgact tcggacattt ccaactccca tggtgtgacg    60
ggcggtgtgt acaagacccg ggaacgtatt caccgcagca ttctgatctg cgattactag   120
cgattccagc ttcgtgtagt cgggttgcag actacagtcc gaactgagac gttattttg   180
agatttgctc ggcctcacgg cttttgcttcc ctttgtttac gccattgtag cacgtgtgta   240
gcccaagtca taagggggcat gatgatttga cgtcatcccc gccttcctcc aggttatccc   300
tggcagtctc cctagagtgc ccggccgaac cgctggctac taaggacagg ggttgcgctc   360
gttgcgggac ttaacccaac atctcacgac acgagctgac gacaaccatg caccacctgt   420
caccgatgct ccgaagagaa agtacattac atactctgtc atcgggatgt caagacttgg   480
taaggttctt cgcgttgctt cgaattaaac cacatgctcc accgcttgtg cgggtccccg   540
tcaattcctt tgagtttcat tcttgcgaac gtactcccca ggtggaatac ttattgcgtt   600
tgctgcggca ccgaagagca atgctccccg cacctagta ttcatcgttt acggcgtgga   660
ctaccagggt atctaatcct gtttgctccc cacgctttcg agcctcagcg tcagttatcg   720
tccagtaagc cgccttcgcc actggtgttc ctcctaatat ctacgcattt caccgctaca   780
ctaggaattc cacttacccc tccgacactc tagtacgaca gtttccaatg cagtaccggg   840
gttgagcccc gggctttcac atcagacttg ccgcaccgcc tgcgctccct ttacacccag   900
taaatccgga taacgcttgc accatacgta ttaccgcggc tgctggcacg tatttagccg   960
gtgcttctta gtcaggtacc gtcattcttc ttccctgctg atagagcttt acataccgaa  1020
atacttcttc gctcacgcgg cgtcgctgca tcagggtttc ccccattgtg caatattccc  1080
cactgctgcc tcccgtagga gtttgggccg tgtctcagtc ccaatgtggc cggtcaccct   1140
ctcaggtcgg ctactgatcg tcgctttggt aggccgttac cctgccaact ggctaatcag   1200
acgcgggtcc atctcatacc accggagttt ttcacaccgg atcatgcgat cctgtgcgct   1260
tatgcggtat tagcagtcgt ttccaactgt tatcccctg tatgaggcag gttacccacg   1320
cgttactcac ccgtccgcca ctcagtcaca aaatcttcat ttccgaagaa atcaaatag   1380
agtgcttcgt ccgactgcag                                                 1400
```

REFERENCES

[1] Spor et al. (2011) *Nat Rev Microbiol.* 9(4):279-90.
[2] Eckburg et al. (2005) *Science.* 10; 308(5728):1635-8.
[3] Macpherson et al. (2001) *Microbes Infect.* 3(12):1021-35
[4] Macpherson et al. (2002) *Cell Mol Life Sci.* 59(12):2088-96.
[5] Mazmanian et al. (2005) *Cell* 15; 122(1):107-18.
[6] Frank et al. (2007) *PNAS* 104(34):13780-5.
[7] Scanlan et al. (2006) *J Clin Microbiol.* 44(11):3980-8.
[8] Kang et al. (2010) *Inflamm Bowel Dis.* 16(12):2034-42.
[9] Machiels et al. (2013) *Gut.* 63(8):1275-83.
[10] WO 2013/050792
[11] WO 03/046580
[12] WO 2013/008039
[13] WO 2014/167338
[14] Goldin and Gorbach (2008) *Clin Infect Dis.* 46 Suppl 2:S96-100.
[15] Azad et al. (2013) *BMJ.* 347:f6471.
[16] WO2013/050792
[17] Mayer et al (2014) *The Journal of Neuroscience* 34(46):15490.15496
[18] Cryan and Dinan (2015) *Neuropsychopharmacology,* 40: 241-2.
[19] Zhou and Foster (2015) *Neuropsychiatric Disease and Treatment* 11: 715-723.
[20] Wang and Kasper (2014) *Brain Behav Immun.* 38: 1-12.
[21] WO2016/203221
[22] Chapter 38—Nonsteroidal anti-inflammatory drugs exposure and the central nervous system (2014) *Handbook of Clinical Neurology* 119, 577-584
[23] Stanton and Savage (1983) *Appl Environ Microbiol.* 45(5):1677-84
[24] Duncan et al. (2006) *Int. J. Syst. Evol. Microbiol.* 56: 2437-2441
[25] Srntková et al. (2011) *J. Microbiol. Methods,* 87(1):10-6.
[26] Pal R et al, *Neurol Res* 2016, 38(12):1111-1122
[27] Daniele S G et al, *Sci Signal* 2015, 8(376):ra45
[28] Wang et al. (2016) *J Neurogasfroenterol Motil* 22: 589-605.
[29] Foguem & Manckoundia (2018) *Current Neurology and Neuroscience Reports,* 18: 24
[30] Ludolph et al. (2009) *Eur J Neurol.* 16(3): 297-309.
[31] Galpern & Lang (2006) *Neurological Progress* 59 (3) 449-458
[32] Zadori et al (2012) *Journal of Neural Transmission,* 119, 2, 275-283
[33] Lee et al (2008) *European J. Cell Biology* 87:389-397
[34] Pirooznia and Elefant (2013) *Front Cell Neurosci.* 7: 30.
[35] Tang, et al. (2017) *J Am Heart Assoc,* 6(10).
[36] Wang et al. (2015) *PNAS* 112(9):2583-2858
[37] Psaty et al. (2003) *JAMA,* 289(19):2534-44
[38] Lancet. (1995) 346(8991-8992):1647-53
[39] Miyamoto-Shinohara et al. (2008) *J. Gen. Appl. Microbiol.,* 54, 9-24.
[40] Cryopreservation and Freeze-Drying Protocols, ed. by Day and McLellan, Humana Press.
[41] Leslie et al. (1995) *Appl. Environ. Microbiol.* 61, 3592-3597.
[42] Mitropoulou et al. (2013) *J Nufr Metab.* (2013) 716861.
[43] Kailasapathy et al. (2002) *Curr Issues Intest Microbiol.* 3(2):39-48.
[44] Handbook of Pharmaceutical Excipients, 2nd Edition, (1994), Edited by A Wade and P J Weller
[45] Remington's Pharmaceutical Sciences, Mack Publishing Co. (A. R. Gennaro edit. 1985)
[46] US 2016/0067188
[47] *Handbook of Microbiological Media,* Fourth Edition (2010) Ronald Atlas, CRC Press.
[48] *Maintaining Cultures for Biotechnology and Industry* (1996) Jennie C. Hunter-Cevera, Academic Press
[49] Strobel (2009) *Methods Mol Biol.* 581:247-61.
[50] Gennaro (2000) *Remington: The Science and Practice of Pharmacy.* 20th edition, ISBN: 0683306472.
[51] *Molecular Biology Techniques: An Intensive Laboratory Course,* (Ream et al., eds., 1998, Academic Press).
[52] *Methods In Enzymology* (S. Colowick and N. Kaplan, eds., Academic Press, Inc.)
[53] *Handbook of Experimental Immunology,* Vols. I-IV (D. M. Weir and C. C. Blackwell, eds, 1986, Blackwell Scientific Publications)
[54] Sambrook et al. (2001) *Molecular Cloning: A Laboratory Manual,* 3rd edition (Cold Spring Harbor Laboratory Press).
[55] *Handbook of Surface and Colloidal Chemistry* (Birdi, K. S. ed., CRC Press, 1997)
[56] Ausubel et al. (eds) (2002) *Short protocols in molecular biology,* 5th edition (Current Protocols).
[57] *PCR (Introduction to Biotechniques Series),* 2nd ed. (Newton & Graham eds., 1997, Springer Verlag)
[58] *Current Protocols in Molecular Biology* (F. M. Ausubel et al., eds., 1987) Supplement 30
[59] Smith & Waterman (1981) *Adv. Appl. Math.* 2: 482-489.

SEQUENCE LISTING (7 sequences)

SEQ ID NO: 1 - DNA, 1487 bp, Roseburia hominis
taaaggttgatcctggctcaggatgaacgctggaggcgtgcttaacacatgcaagtcgaacgaagcactttaattgatttcttcggaatgaagtttttgtgactgagtggcggacgggtgagtaacgcgtgggtaacctcgctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtgggtaatattgcacaatgggggaaaccctgatgcagcgacgccgagtgagcgaagaagtatttcggtatgtaaagctctatcagcaggaagaagaatgacggtacctgactaaaaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagggtgtctgaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacaaagtatgtaatgtactttctcttcggagcagtggtgacaggtggtgcatggttgtcgtcagctcgtgtcgtgagatgttgggttaagtcccgcaacgagcgcaacccctattcttagtagccagcggtttggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaagcaggactgataactggggtgaagtcgtaacaagt

SEQ ID NO: 2 - DNA, 1485 bp, Roseburia hominis
gatcctggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgcggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacagagtatgtaatgtactttctcttcggagcagtggtgacaggtggtgcatggttgtcgtcagctcgtgtcgtgagatgttgggttaagtcccgcaacgagcgcaacccctattcttagtagccagcggttcggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggactgataactggggtgaagtcgtaacaagggtacg

SEQ ID NO: 3 - DNA, 1500 bp, Roseburia hominis
  modified_base (862)..(862): a, c, t, g, unknown or other
  modified_base (933)..(933): a, c, t, g, unknown or other
aagagtttggghcaggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtatnccacctggggagtacgttcgcaagaatgaaactcaaaggaattgacggggacccgcacaagcggtggagcntgtggtttaattcgaagcaacgcgaagaaccttaccaagtcttgacatcccactgacagagtatgtaatgtactttctcttcggagcagtggtgacaggtggtgcatggttgtcgtcagctcgtgtcgtgagatgttgggttaagtcccgcaacgagcgcaacccctattcttagtagccagcggtttggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggactgataactggggtgaagtctacrsagggtagccgtrmmc

SEQ ID NO: 4 - DNA, 3592167 bp, Roseburia hominis (residues 1-1,796,084 of 3,592,167)
gtgcttgaatatggtgcttgtcattgtattcaagctcggcgttgccggtgtggcgatcgccacggtcatctcgcagatgatttcctgcgtgctggtgctgcggtgcctctgtcggtcggagagcagttaccggctgcggttttccgagcttggcatgaaagggtactacttgaagcagatcttttcggtcggcgttccggcaggaatccagagtacggtcattaacttttccaatgtgctcctgcagtcctcggtcaattcgttcggatcgacggcgatggcaggctacacggcggcaaacaatctgctcggcttcttgtatgtctcggtgaactccatcacacaggcgtgcatgagctttaccagccagaattacggcgttggaaaattaaagcgcatggatcgtgtgctggcagactgcatgatcttatcggtcgtggtcgctgtggttttgggatgcatctgctatgggttcggaccggaaattttacagatctacacggaggatgccgaggtaattgcgtgcggtatggagatccttgcatacacgacgatcacctattttctttgcggctggatggatttgttcccgggggcgctgcgcggcatgggatattccgcggtgccgatggtgttgtcggtcatcggaacggttggtacgagagtggtgtggatttttggcatttttccataccacagatcactggcgattctgtttatatcttatccagcgtcgtggattatcacgattgtcctgcaggtaatctgtttttactttgtgagacggagagtgcaccggagaagtcaggcgctcgccggacaggaagcctgattcctcaatcagccaggaaacccagtggaaagtgacaggtcatctgtcggaactctgccggatcgaggcaaaagcccaatcccagaatccgacaggaaccccagctcatagtccagctcatataactacacggagacaacgatggaagcatattattacagcaaaatggacaaaacaaagcaggcggcatatcatgcgatgctgcagggactattggcgttggaggatgccattccgatgccgcgccttgaggcggaggatctctatcaggtatttttcctgctgcggctggatcatccggagattttctgggcgaccggctacaagtaccggtattatccggagtcggcgaaccttgtgttcctgccggaatacctctttgaaaaaggcaagatcagagagcaccagaaggcgatgaaggcgcgggtggaaaaactggcgcgcgcggcgcagaatctctccgagtgggagaaagaaaaatacgtccatgactttatctgcgaaaacgtgcactacgataagctgaaaaagccgtattcccatgagatcataggtcctctcggacagggtgtgggcgtctgtgagggaatcgcaaagtcagtaaaggtgctttgcgatgcgcttggcgtttggtgcgtgattgctctgtgcggaaactgcccagagaaggggatcaaataccgccatacgtggaacattgtaaaaatcggcgggcagtattatcatctggatgccacatttgacaacacgctcggtgcgggagcacagatccggtacgattatttcaatctctgcgacaagagcgtattccgggatcatcagcccctgatcgcgcctgcgccggaatgtacggatgcacagcatttttattatcgggagaaaaagctttccttcacgaagatggaggatgtctataaacgtgcgcttcagacagcaaaaaaaggaaaaacgtttacctttcactggaggggcgggtatctcaccagggaggtcttgggggaactgttagaacagatttccgcggccggcagggagcgagaaaaaagcgccagagtcagtgtgaactggcagcaggcggtgctccggttcgattatgtggaggcgggcagcgcgccggaggcgagtgttgtgatggaagaagcaaatgagggagaaaaagaatgacggaagacttactggaacagattcagagaaaagacgcggcggcgtttacacacggagggaaatttcatgcagacgatgtgttttccgcggcgctgctgctttacctgaatccggagattgtaattacgcgcggcaacagggtgccggagaattttgccgggatcgtgtttgacatcggaagaggacggtacgaccatcatcagaaagacagccgggtgcgggagaacggtgtgccctatgcggcgttcggactgctgtgggaggaactcgggggagcaatcctcggggaggagctggcggcggaatttgacgaggcgtttgtacagccgttggataataacgacaacaccggggagaaaaacgagctggcgacgctcattggcaattttaacccggcatgggatgcgcagggcggaagcgatgccgccttttttcaggcggtcagcgtggcaggcatgattcttgaaaataaatttgagcgctatcgcggaaatgagcgcgccgaccgtcagatcgaggaagtgctggcggcgcatgagcgtgccgtagtgtccggggagacggcggagcgcgatgccgcgattctcatattgccctattttatcccgtgccagaaacgcctgtcggagaccgggattgcgtttgtgattttcccgtcgaaccggggcggatactgtatccagccgcagaagcgggagtattctctccattataagtgcagcttcccggaatgctggctcggactggaaaaggaagaactggcggaggcatcaggtttagagagcgccgttttctgccataagggcggttttctcatgacggtcggggaactttccgatgcagtggaggcatgccggatcagtctggacagctttaaggaggagaaggcgcttgtaaacgtgggcggcggagagacagcggatgaacttttaagagaactgccggggatggcggaagcgcagatctatcacatgccgctgccagagctgccggaactggaacaggacggcagttacggtgaagtggcgatggaaaaagccgactggaagcttcggaacaaggattatgtgaaacagatcctgcagtgccgtccggaggccgtttacgtcgagggggatgtatttgcggcatatccggtggtgcatctgctccggaaaaagcacgtgccggtgcttgccatggcggagcgcggcgggaagcggattctcgtgcggattccgtccggttcctagatgggacttgtagaagacaagcgaaaagtgctatgattcttatgcaatgtggaatatgctttcaggaatttctgcttccggcgaagaggcaggaaaatcagatagacataccaaggaggaatggacaatggcttgtacaacgattttagtgggaaaaaaagcatcatatgatggatcaacgatgattgcgcgcaacgacgattcgggttcgggacattttacaccgaagaaatttgtggtcgtgcagccccaggagcagccgcgacactacgagtctgtgatttcacatgtgaagatcgagctgccggagcagccgatgcgctacacggcggtgccgaatgcggtcgacgggaaaggtatctgggcggcaagcggcgtgaatgaggcgcatgttgccatgacggcgacggagacgatcacctcgaatccgcgcgtgctcggcgtagatccgctggtggtataccagaaggcagaggatggtcagccggagatatgtggagggatcggcgaggaagatcttgtgtgtcttgtacttccgtatatccgcagcgccagagagggtgtcagacgtctgggaagcctgctggagcagtacggcacctatgagatgaacggcattgcatttcaggatcaggatgagatctggtggctggagacaatcggcggacatcactggatggcgcgcagagtgccggatgatgtctatgtggtcatgccgaaccagcttggaatcgaccggtttgatttttccgatgccctcggggagcagaaggaatatatgtgctcggcggatctggaagaattcgtaaagacgtatcatctggatctctcacaggatggcgagtttcatccgcgcgacgcgttcggcagccatgacgatgcggatcatgtatacaacacgccgcgtgcgtggttcatggagcgctatctgaatccgcacacgaaggtgtgggacggaccgcatgcggatttcacaccggtttcggatgatcttccgtggtgcatggtgccggagaaaaaggtgacggtggaggacgtcaaatacgtcttgtcctcccatttccagggaacgccgtatgatccgtatgccgcttacggggataagtccctgcgcggtgcataccgctcgatcggcatcaaccggaacgattttctcgcagtgatccagatgcgcccgcagatggagcaggagaacggcgtgattgaatggctggcatttgcgtcgaacgcatttaacgtgttggtgccgttctatgccgatgtggaggagacaccggaatatctggcgaacacgacgggcgaggtgtccacggagaacttttactggtcgagccggctgattgcggcgatggcagacgcatcctaccggagctcggtgttccatatcgagcgctatcaggagcatgtgatggcgaagggacacgagctgatccatcactacgacgcgctcctctccaaggagacggatgccgtgatgcgcagaagacttcgcgaggaggcaaaccgcagtattgcgaagatgctgcagaaggagacggcagataccctggacaaggttttatatgaacttagcggccagatgaagaatgcatattccagatcggatgcatagggaggactgccatggtaaaaattgatctgatcacgggtttcctcggatctgggaagacgacgtttttgaaaaaatatgcgaaacgcctgatggagcaggggcagaatatcggaatcctggaaaatgatttcggcgcggtcaatgtcgatatgatgctgctgcaggagttagagggggagcagtgcgagctggagatgatctccggtggctgcgaccccgagacgcaccgcagaaggttccgcaccaagctgatcgccatgggaatgtgcgggtatgaccgcgtgctcgtggagccgtcgggaatctacgacatggacgagttctttgacgtgctgcacgaggagccgctggatcggtggtatgagatcggcaatgtgatcgctgtggtggacgcgcggctggaggacgcgctttcgccggaggcggagtacctgctggcatcgcaggcggcaaatgccggctgtatgattttaagcaagtgcgacacggcgacagaggagcagcggcggaatacaatcgcgcatctgaagcggtcgcttacagcactcggctgcaagcagcgggcggatcagaaggttttgtgcgagggcgcagaaccgctcccggatcaggattttgccacaattctctcctgcggttatcacatcgcaagctatgagaagccggactttgcgaagggacagtcgtttgaatcgctgtattttctggatatgcacctggacggggatgcggttacggcggcggtgaagaagatgctgaaagatccgtcgtgcggacatattttccgtgtgaagggatttttgcagaattcggacggcacatggctggagatcaatgcaacacagcaggagatcacgcgaaagccgattgcaaacgggcaggacgttctgattgtgatcggagagaagcttgtggaagacgccatccgggcgtattggaaaggttagagacagacgatgatttatgtggtgacggcgctctatcaggaggcacacggattcatccgggaactggaattaaaaaagaacacggcgtatgcgccatttgaggtgtttgacaatgagaacgccggcatccggctggttgtgaccggtgtgggggagattgcggcggccgcggtggtcgccgcagtctgtgcgcaggatggagctgatgcggcagactttctcatcaatatcggctgctgcgcggcagcaaacgctggcgcggacagtggctgtgaaactgtagacagtggcatggacagcggatacggggcggcacacgccgcacagatcggagacctgtacgtgtgtcacaagatcacggagcaggcgaccgggaaaacgttctatccggatattctgtaccggcacccgtggaaggaacgtgaacttgtgaccgggatgcagccgctgcaaagagcagcggcacacggagctttatatgatatggaagcggcggccgtctatcaggcaggcatccgctttttttctccggaccggatgctttttttgaaggtggtatcggatttcggaattgcagggcaggagagaatgacggcggaggcgctcacggggctgctggagcagcatgtaaaggaggtcgtggcatttcttacaaatctgcgggaggcggcagacgaggaggagacgctgcgaaacgacggtattttgcaggaagacgagacggtgctggagcggctttttgcggcgctgcactgctcgcagacgatgcgggcgtcggcgcggcagtatatcacgtatgcggcgcttaccggatacgactggaaagcggaactggaagaatggtatgcgcgggggctgctcccgtgcaaagacaggcgggaagggaaggtgcggcttgaagaacttaaacaggtcttattataatccgccgttttcccatatttatgtggagcgggaagtggcggaagatccggagactaagcggatgcttgcgcagtttccgcaggcggaagtgattgacatcgaccactataaggatgttttctgccggagcaggcaggactatgtcaggcagcatgcggcgcagaatctgattctggcggcgaagcacggtgagctgctctaccccggcgcgccggtctgccagaactttggaaatgagcatttttactacacctcctgtgtgatgaactgcgtgtttgactgtgaatactgctatctgaagggaatgtatccgtccgccaacctggtggtgttcgtcaatcttgaggatatttttgcggaagtggaaaagagacttgacgcgcacccggtctacctgtgcgtgtcctacgacacggatctgctggcgttagagcatctgaccggttatgcggcacgctggattgagtttgtgcgcaggatgaacaccggcgggcagcggctgcgcatcgagcttagaaccaagggaaccggaggcagcctgtggcagacggtccggccggaggcaggtgtcatctgtgcgtttaccatctcaccgcagcaggtgattgatgcatatgagcacggtacggcttcgctcgccgggcggctggcaggagcggaagcggcgatggaacaaggcttttcggtgcgtctctgctttgacccgatgatctattgcagcgactggaagaagcactatgacgcgatgtttgcgcaggtctgcgggacgctggacctggaaaaactggcggatgtcagcgtcggaaccttccgcatctcccaggattatctgaagaagatgcggaaaaatgagccggactcggcggtggtgcagttcccctaccagaatgacggcggggtgtaccattacccgacggcgctcatggaggagatggagcagtatatgacggaaaaacttgccgcttatcttccggcagagcggattttccagtggaaggaataaggagagaatacatggagcagtgtagagaaaacgaggcggcgattgtcacgggggcgtcctccgggatcggggcggcgatcagtgccagactgtgcaaaatgggatatgaagtgtttggcatcggacgctcgttcggcagcagtttcgcggaacagtttccggacgttgcagataatccgctgtttcatgcggtggtctgcgatcttctggacacggaaaaaatgttgaagctggtgcgggggattgtggcggaagccggggtaacgctgctcgtcaacaatgccggcagcgcgtactacggactgcacgaggaactaagcccgaagaagattcaggagatggtgcgcacagatctggaagtgccgatgattttaagccagcagctgctgcgcgggtttaagaaaaacaagggctgcatcgtcaatatcgcatccgtgacggcgcagcagtcgaatccgcacggctgtgcctacggcgcggtaaaggcaggacttgcgagcttttcgtgcagcctctttgacgaggcgcgaaaatacggtgtgcgcgtggcgacggtatccccggatatgacgaagacggaattgtatcgcaatgcagactttacggtgggggaggagacggagagctatcttctgccgcaggacgtcgcggaggcggtggcgtatatcgtggggcagagagagggcgtggcggtgtcggaggtgacgctccgcccgcagtatcacagaatccggcgcaagccggtagcgaaaaaggagagaccggtcgaatgaaagatcttacaaaaggaaaaccgtcaacgctgattcttgcgtttgcactgccgatatttctggggaatctgctgcagctgacctacagtgtgaccgacacgagaattgtcggctcttttctcggggaggatgcgctcgctgcagtcggtgcaacgacgacactcagcaatctcatcatcggctttttgctcggactggcgaacgggtttgccatcatcacggcgcagcggttcggcgcgaaggatatccggggcgtgaaaaaatcgtttgccgcttccctggtgctcggaacggtgatctcggtcgtgctgacggtgctaggactggtgtttttacagccgatcctgcggtttttaaatgtgccggagcatctgattccggtggcaggaccttacatatttatcatcatagcgggacttcttgcgacattcctctatgacgcgtgtgccgcagcacttcgggcgctcggggataccgtcacgccgctcgtgattctggcagtgtcggtggcgttaaatatcgcgggagatcttctgttcgtgctggtgttaaaggcgggtgtgcgcggagctgccgccgccacggttctggcacagattctggcgtttgtgatctgctggatctacatgctaagacggtatgaaatgctccgtcttgcacaggaggatttccgggatgcggatacggcgatggtgaaaaacatgctcggatcggggctgtcgatgggctttatgagctcgctggtcaatatcggctcgctgacactccagacggcgatcaataagctggggcaggacatcatcgtggcgcacacggcggcgcggaaaatttccgagatttttatgacgatgttcagcgtcttcggacagacgatggcgacctactgcggacagaatctgggcgcgggcaggatcgaccgggtcaaaaaaggcatccggctcggcattttctacacctgcatctggtgtacgctttccgcggtggcgagctacacgattggcagatggctggtatatcttgtgacgggaagcacgaatgaggttgtgatcttaaatgcgaccaactacctgaaattcgacacgctgttctactatgtgacggcggtgatctgcgtgctccgaaacgccatgcagggactgggcgatcatatcacgccgctcatttcgagttcgcttgagatggtcgggaaaatcgtgatcgccgccacgcttgtgccgatgttaggctacaccggtgtcattgtggcggagccgctcgtgtggtttatcatggtaattccgctcgtcgtgcagatcttccggatgccggtactttgggaagaaaacatgggaaatcaaggaaaatgatgcgtagttggacgataacaacgcttgaaatgctgtaaaatcaagcaattacaggatttcacaaaaagttcacagaaaattagcactcaacacttgacagtgctaataaacggtgttataacatagtcagaacaaaggagaggaacaaaaggagaacaggaaatgagttctatgagttcccagaacatcccggttccaaagaaacaaggaaacagcatgagtgtatctgccgaaggcaggtacgaagtagaaaaggagagatgacttatgttaacacctagtatttttggagagaacttatttgatgactggtttgatgattttccatttttcgatgacagagatttgcgcaaggttgacaagaagctgtacggcagaagagccggtaacctgatgaagacagatattcaggagatgaaggatggctacaagatggaagttgatcttccgggcttcaagaaggatgagattaccgtagagctggatgacggatatctgaccatcagtgccgccaagggactggatcaggacgagaaggagaaagaatccggacgttacatccgcagagagcgttatgcaggtgcctgcagccggagcttctatgtgggcgagggcgtaaccgaggaggatatcaaggctgagttcaagcacggtatcttaacgctggttgttccgaagaaggaagcaaagcctgcagtagagcagaagaaatacattgcgattgaaggataaggatgacagagagaaaggaagcgtatgatcatgtcagataagaatccaaaacatccgttgaagaagaaaaaagtagcagcaaaggtgaatatggcagaccatgaggcggtcgaggaagcgagagaagcccacaagtcgaaaaagcatgtttactaagcgatacgcctgcagatgacaggagaaaagggacagggagctgcacagcacgaagtgctgtgcgcccctgtccctttttcgtcattaggctttagcctgctgaatgcgtgtttacgagtttctcaacagagaaacgaagtacgcataaagcaaaaacccacctgctatgcgggtggagtcaaatcgttatacagaaaaacacctttccgttacaatagagttgttcagtcactattgcaagaaaggaaaggtgttttatggcgaataagtctaatgatctcgcccatacaaaatggatgtgtaaataccatattgtatttactcctaagtatagacgaaaaattatttataatcaattaaaagaggatatacgtgatattctgaaacagttatgtgcatataagggcgtggagattattgaagggcatctcatgcctgaccatattcatatgctagtaagtattccgccaaagatgagcgtgtcgagttttatgggatatttaaagggaaagtcagcgcttatgatttttgacagacatgcaaatctcaaatataaatttggaaacagacatttctggtcagagggatattatgtcagcaccgtaggattaaatgaagcgacaataaaaaagtatattcaagatcaagaaaagtacgatatcatgcaagataaattaagtgtgaaggagtacgaagacccttttaagggttaagtcgaagtagtacaaacgcccattcatgggcataagcaacgcgtcaagtgcaatagtgacttgaacgaagagaaagtctagggcgccttgagacgctgtcgggtaccaaggggttacacccagcgtcccgagccaccctttttaagggtggcggcgactgtaataggaaacttcgttcctattacacaaaaacgtgtccaaagattacctattcgctaatccaactgcatggagttgagtttttctgccagcagatccagaaagcgcttgccgaaattacttagttcgtgatccctgcgggagatccagccaagttcgatccgttgatgcgtgtccagattcatgacggcgtaatctttttccagcagattttcaccggacatgccggaaccgatggtataggtgttcatctccatgccgatgctggcatctgccatctcgtccgtgagggtgattgttttttttgcgacggtattctccacaagctcctcggagaagaagcggtctctggaactgtcgattccctgaaaatagtggctgtagacatagggagccaggtcttccatcgataccttcgtcctgccggcgagcggatgctgcttgggaacatagactttggggcgcatggttgccagcagatgaaaatcaagttcctgctgctccatctcccagtcgagaacgcggttctcacggtttttcaacagaacgccgatctcacagaattccgatgcgacgtaatctaagatctccttggtgcgcagctggagatactggaaattgtattcgttaaagtgcgggtcctgctccttcatgaaggcaatcatgacctctgtcacaatggaaatgtgctgtgtggcaacgctaaaagagatcctgtggctgctcggctgtttgtaggtgtcctcaaggcgctgcacctggtttaagatcggctggatcgagcgaaccagctcggcgccgtcgggggttaaagagacgccactttttttccgctcgaagatctggatgccgagttcctgctccagatctttgatcgcgttcgacagattgggctgtgacagctggaatttctcagcagcacttgtgatggaataacattctgcggttgtaatcacatatctcatttgttgtagtgtcatggttatactccttttgtcagagctgcctgctcacgtttcatctgcgcattgtgccgcacaaacatgccggcggcgacaaggtttaatagaaactgtgtaatcacggcagtcagccagattccgtccgtcccgaagaaatgcggcagcactgccaatgctgcaggagtcagacagagtggatcaaaatagatcataaataaagaatagcggttctttcctacggcatagaagaagctgttggttactctcacgatgccggtaaagatgagctgggcagcggtaagcataaccgcgtgatagccggcagcagcagcgtctccctgatagccgtacagagccggatagaaggaggcggtggcgatggtgaacaaaaacagaagaacgctggcggcaatcgcagtccggatggctttgttacggatatgccggatctcgtcgtaggcggcgatccgctctgcgggagtggcatttccgttctgcgatgcgccgtaggctttgctggcaagcggctgcattccctccgcaacgccgatcagcagaatccggtacgagccgatggttgaggagatcagcgcatatgcgctcacggcaagatccccgtaattcaggcaggcgatgttgtgatagagaattaaaagcgacggcgtcagtgatattccgaaaggagagattccgatggaaaaaatgcgcttccagcagtctttctcaaagacgaactgctccctgtgcagggggcagagagatgtgccggcagagcccggaaggccgagccgcgcgcggaggcggtctgtgacaccgaaaagtgtgagaaaacagagggcggtggtcagcagctgcgcgcccaaagaggccagagcggcgcctccgattcccagatggaaaaagtaaagcagtacgaaatccatcgtgagattaaagaggaaccccaggaccatgatggtcatggcaccgacctgccggttctcattccttaatataggtgcaagtccgcaggataaaacctggatgacgccgcctgcaatcatgattctgccgtactgttccgcagcggtgagcagattgccggaggcgcccatcagttttagcagcggcgttaaaaatagagggacagtatgaagcgggatatgcctcgggactgacaaaagcacagacctttttccatgtgattgtgccgcaggcggtgcgggcggtcattccgccgctcacgaacgatattctctccctggtaaagggaacggcgttagtgtcggtcatcggagtgtcggatattctgacggattccatcaatgcggcaagcgcggcgtactcttacctggaggcgtatgtggcggcagccctggtattctggggcatcggaattgtgttagagcggctaagccactatgtggagcggaaattttcaaaaagcgttaagacactggcaggctgagatgcggtacggcatcgtacattattataataggaaggaaacagggctatggcagtattagaagtgagaaatgtaaaaaaggtttttggagataacgtgattttaagaggaatcgatcttgatgtacagaaagggaacgtcatcgtcatactcggaccgagcggttccggtaagaccacctttttgcgctgcctgaatcttctggaaaaaccggatgaaggctcgatggtcttaaacggaagagaatataacttaaaaaatgtaaaaaataaagaaaagctggagattcggagaaatacttccttcgtttttcagaattacaatctcttcgtgaacaagacggttctttctaatgtgacgctggggcttaccgtgggacgccatatgaaaaaggaagaggcggagaagatcggaaaagaactgttagacaaggttggtcttgcaggaaagtacgattattacccggcacagctatccggcggcatgcagcagcgtgtcggaattgcacgggcaatggcggcgaatccggaggtcattcttttcgacgagccgacgtccgcactcgatccggagctggtgggtgaggtgttaaatgtcatgaaacagttcgcaaaacagggagtcacaatgattgtggtaacacatgagatgcagtttgcaagagaagtggcaagccaggttattttcatggcagacggtgtggttgtggaaaaaggaacgccggaggagatctttgaccatccgaaggaggaggcaaccagaaaattcttaaaacgtattttaaaggaagagtcatagctgtgtgcgaagacggagaggagagaaagatatgcagaaatatgtgatttcgatttcaagacaattcggaagtctgggaagaccgattgcaaagaaactggcagaacttctggaaattgaatactatgacagggatattgtggaggaggcatccaaagttcacaacattccgttaaaggaagcgagcaatctggaggagtcggcaaagtatctgttcatgagtttcccactcggcagcggaaccacggcgacgcaggatgccctgtttaagacggagagcgagatgataaaaaaacttgccgtgaaggaatcctgcatcattgtcggcagatgcgcggacgcaattctggaggattgcgatcatctgatcagaatttttatctatgcgccgtacgaagaccgcattgtcaactgtgtcaatgatctcggcatggacacaaaggcggcgaagcggatgatccgtgatgtggacaaggcgagagatgcctaccatatgcggtatgcggggtatctgccgaacgatatgaaccatatggatctgatggtcaacagcgcaactctgggagtcgatatgacagcgagactgttggcggaagtggtgcgtgataaattttcataagacgggcagtgtgcgtaagactgcacagtgccacagaggataaggcatggaaaaacacagaaaaaaactgatcaaaaacgcagcggtattcgacgggcacagcagtgggctggcgcatgggaaaaagattgtcattgaagacgatcttgtcacagagattaccggggatgaagtatcggaagaaaattttgacgaggtatttgacggcacgggcatggtggcgatgccgggaatgacggacgcgcatgttcacatgggctgtctgttcgcaaagggagaattcccggtggattacgctacggtgctgaccgtcgcaaaatgtaaggatgcgctgatggccgggtttaccacgttccgtgatgcgggaagtgtgagcgagggattaaagctggcgtttgacgagggtgtgcttccaggtccgcgcatctatccctgcggtgcctacatcagccagacgtgcgggcatggggattcggagtatgcgcatacctatcgcgacatccagtacaggcatccgtccagcaccgttttggcggacggggtgccggagatcatccgggcagtgcgcgagcagttctaccgcggtgcatcccacatcaaactgatggcgggcggcggctgcatgtccagctgtgacccgattgagaccgtacagtttacagcggaggagatgaaagccgcctgcgatgtggcagcagattacggaacctacgtcatggcgcatctgtatacgccgaaggcgatcctgcgcgcgctgggagcgggcgtgcggagtctcgagcacgcacatctcatcgacgagacggcggcagagcaggtggcggcggcaggagcatttttaaatcccatgcctcagtttaaaaagtatgaggacatgctcggtgtagagaacatgccgccgaaagacgagatggtgtgctgtgcggaggcgacggctaccgagatcttaaaccggcatgaggatatcaggcttttgttcggaacggatatgatgatcacgggaccggattatcaggtggagcagagcgaggatatccggtattacgaaaagcgcttcggcacaatgcgggcgctgagggctttgacgggcactgcaaacgaggtgtttgcacttacgacctaccagaatccttacccgaagggaaagatcggtgtgctggaggcgggatcctatgcagatctgcttctggtggatggagatccgacaaaaagtgtatcggttcttgcagacaccgatcatctgcgcctgattatgaaagggggaacggtgtacaaaaatacactgtgctgagattttattccgctaatacgctgacttgcatgtggctgagattcgtagtaatcttattccaaaaactagaagcaggaggtaattatgaaagagctgctgtactggattgtggaatggattgcgaagattcacagccacattcttcgtctgaatgatgcgtatgaatacaattttacagataaagaactgcattttctcgtcattggtatgatgggaatgggattcatttttgtcgtgtatcctgtttttaaatggctggcaaagcatgatcatgtcatggtaattgcgtggatttatgtgctgacactgattatcgtgatcacgtttgccatagagatcgggcagaaagtaacaggcaccggcaatatggaatttgcagacattgtgatgggtgtattcggattcattgtaatgttccttgtgttctcggttgtgcggggtatttataagctgataagaaatctgatcagaggagacaggaaagatgaatgaattttggaaaagagtgctcgagacgtgcgtggtgattctggggaactgcctgtatgcattcggtgtggcaatgttcattgtgccgggaggactgattaccggcggaacgacgggaattgcgctgtttgtgcaccacatgatgggttgttccgtctccgtgtttgtactgctgttcaatacggttatgtttctgatcggatttgcggtattcgggaaaaaatttgcagcaaacacactggtcagcaccttcagctatccggtagcgctggagctgtttacacggcttctgcacggctatgcgatcacggacgatatgattctctgcatgatctttggaggaatctgtatcggaggagccatcggcgttgtgatccgtgcgggcgcatcgactggcggcatggatataccgccgcttgtgttgaaccgttattttaagataccggtgtcaaagtccatttatgtattcgatatgctgattttgctgctccaggcgtttgacagtacaggagaacagcttctctatggtattctgctggtgattgtctacagcgtggtgctggataagtgcctgatgcttggaactgcaaagatgcagatcaaagtagtcagtgagaaaatcgatgagatcagaaaagcagtcttaacagatatcgaccgcggtgttacaatgttaaaaagtgagaccggatacatggagcgggagacagagatgctgcttacggtggtgtcaatacaggaactggcgaagacggagaagctgatccattcggtggatgaggatgcatttgttgtgatcaatcgtgtcagtgaggtttccggccgcggtttttcaagtaaaaagcgttatctggaaaaggagaattcatgacattacagcaactgagatatgcactgacgatagccggctgcggatcgatgaatgaggcggcaaagcgtctgtttttatcgcagcccagtctgtccgagacggtaaaggaactggagcaggagatcgggctgcagatttttatgcgctcgaaccggggaatcatcatcacaccggagggtgaggagtttctggggtacgccagacaggtgatcgaccagtacggaatccttaaggcgcgctatgtggagaagcagcgcaaggaaaagttcagtgtgtccatgcagcactatacgtttgcagtcaaagcgtttgtggagactgtaaagaaagcagggatggacagctatgaattcgcggcgaacgagacgaccacatacgacgttatggagaatgtacgcaattttaagagcgagatcggcgttctgtatctgaacgattttaatgagcaggtgctgatgaagatcatccgggagaaggggttggagttcgaggaactgtttgcctgcgatacctatgtctatctgtggtcgggacatccgcttgcagggcagagcgtgatctccatggaagaactggacgagtatccgtgcctgtcctttgaccagggacggaacagctcgctctacctcgcggaagagatgaagagcacctacgattataagcggctgattaaggcgaacgaccgggcaacactgctaaactttatgattgggctgaacgcgtacacgctgtgctcgggaattatctgcgaggagctaaacggcagcgattacatggcaattccactcaaggagacggaaaagatgcggattggctatgtgaagcgcaaaggggcatcaatcagtcacatcggacagatctatatcgaagaattgaaaaaatataaagagaaaattatgtagtggttggctataggtttcacctatagccaactatcggcttcctgtattaacactttcccaaactgcctgttataataggcaatgtaatcaaaaaaaacatgcagataacagatggcatggagcaaaaagcaggaaggaggaaacgggtatgagagacacagcgtggcagatgagaacagcgatgatgtgtgacaggatgtgtcggatgtccatgtatggtggcatggatgtgaatgttgtgcggcttttcccggattcttcagacctttggaagaacagatagataccggcgctatggagcgcaggttggggcagccgcagggctgcttttttttatttcataggaaataccgtgatacattcatgtgtgaaagtggaactttcctatgaaataaaaaacgctccgcgaggatgcgcagctcgcggtaaggaaaatattgctttgcgaaccgctcgcgcgcggagaatctcgcaagcgagattctttttaattctatgtttttgaaataacattttaggaggtggcagtgcatgccagcaattgcgatacgtcatttatcaaagaccttcgagcagaagggaaacagtgtggaagcgttgcgggatatctcgctcgacattgaggagggagacatctacggaattatcggaatgtccggtgccgggaaaagtactctggtgcggtgcctgaattatctggagaggccgacgggcggtgaggtcatcatcggtggtagagatctgggaacgctgaccgagaaagaactgcgggagcagcggagcgacatcgcaatgattttccagcatttcaaccttctcatgcaaaagagtgtgctggacaatgtatgtttcccgatgcagattgcgaagaaaaagaaggatgaggcgaagaaaagagcgcttgagctgctcgagactgtcggacttgccgacaaggcggacgcttatccggcacagctttccggcggacagaagcagagagtggcgatcgccagagctcttgcgacggatccgaagattctgctctgcgacgaggcaaccagtgccttagatccgcagacaacgcagtccattctggcactcttaaaggagatcaaccggaaattcggcatcacgattgtgattatcacgcatcagatgtccgtgatccgggaaatctgcagccatgtggcgattgtggaaaaaggaagcatcgtggaagtcggcctggtcgaggagattttcaaccatccgaaatcccgtgtggcgagaagcctgatcttgagcgaccgtgctgcggatgccgcgtcatattccggggcggaaggtgatactgcggatggagcggagctgaccggatggagcggtgagagcagacagcgggaccgcatcggcgacgataagaagcttcgtattgtattctcagagaattccgcatttgagcccgtcattgccaatatggtgttaaagttcggtacgccggtgaacatcctccgcgcagataccaagaatgtcggcggagtggcaaagggtgagatgattctgggacttccgtcagacgccgggctgcaggagcagatggaggcttatctggtggaaaagggacttgagattgaggaggtgaccggagatgtggaatagtcaggtaatcatcatgcttttggagggaatccgggacaccctgtatatgaccttagcgtccacattgtttggatatatcatcggacttccgatgggaattgtgctgactgtcacggacaaggacggcatccgtccgaatgcggcagtctacaaggtgctggatgtgatttccaacctgctgcgcagtattccgtttattattttgctgattgtgctgattccgttcaccagatttgtggtgggaagaagctacggatcgacggcgacgatcgtcccgctgacgattgcggcggcaccttacattgccagaatggtagaatcctcattaaaagaggtggatgcaggcgtcatcgaggcagcgcgctccatgggagcatccgattttcagattgtgaccaaggtcatgctggtggaggcgagaacgtctctgattgtcggagcaacgatttcccttggcacgattttaggatattccgcgatggcaggaaccgtcggcggaggcggactgggagatattgccatccgctatggttacaccagatggcagaccgatatcatggttgtcacagtggtgcttctggtaattttattccagattttccagacgatcggaatgaagattgcgaatcggctggatcgcagaaagtagcaataacaaatttgcatatatttttaagttttaaggaggacactattatgaaaaagaaagtattgtcaacgattctggcaggcgtgctcgcattatccgcattcgcaggatgcggaagcagcacggaggagagcacagacaccagtgcagcaacaaaggaagagacgcccgtagctgcaacggaggaggctgtgagtgctgagaacacagagagcaccgataccgcagcagaaggcggcaccatcaaagtggctgcatccgcaacaccgcacgcagagattcttgaggaagcaaagaagattcttgccgatgagggatggaatctggagatcaagattttcgacgactatgtaatgccgaacgaagtggtagaaagcggcgagtttgacgcaaactacttccagcacattccgtaccttgagagctttaacgaagagaagggaacccatctggtcaatgcaggcggcatccactatgagccgttcggcatttatccgggaacaaagtccgatctctccgagctggctgacggcgacaccatcgcagtgccgaacgataccacaaacgaggcgagagcacttcttctgttacaggataacggcatcattaccttaaaggaaggcgccggattagaggcaactgttaatgatatcgcagagaacccgcacaacgtcaagatcgaggagctggcagcagagcaggttgcaagagtggctccggaggttgcattcgtcgtattaaacggtaactatgcattacaggcagggcttctccgttgcaaaagatgcattggcttacgaggcatccgattccgaggcagcgaagacctacgtgaacatcattgcagtaaaagagggacatgagaatgaccctggcatccaggcacttgtaaaagtattaaagtctgatgagatcaagcagtacatcaacgacacctatgacggagctgttatcccgtttgaggactaagcaaatagaggaaagaattgtcgaaatcagcatattgtgttttgtgtcgataagtaatattacgaacaatagatacttaaaagttccagataaacatgcggcggcaaattctgaccgcaaaatccggtatttctaaccatgccgcagctggcatcctcgatgatccgtgtctttccaagtttggagcactccacggactgtgtccgcaagccagcagacaattttagaacttttgtgtgtgtcccttgcggcaccagacaacagatggcataaatgccatctttatgtcgaacaaaacataaccgcgcgaagctgatgtttgaattgccatctgccatatttttaatagcagatggcaacgagtttcggttcgcgcggtttttatattgtctgtgaagaggtgccattagggacaccagaaagtccgctcattgtctgcggcttgtcggacacactccgtgagtgtccaaacgtggaagagacacggaatgggatgccagccacggcatggaagaaatacgtgaattttgcttcaaagaatttcccgccgtctgtttattctggaacttttttgttctctggtcttctaataatattacttatcatcccaaagcggtctatgctgattgcaacaatttcttttgcaatattttgtagaagaagagtttctttcggctgtatgttgtggtaaaataacagatataagctgggagtaaaatttcccggcaattacgaaggggaatggagagaagtaccatgaaagaggagcagaaagtatcatttattcactcaatttcagcaaagatcatgctgctgaccgtgcttgcagtggttatgtcggtgttgatcgtcgcattccgggcggaagcgggagcaaagaaggttgtcggagacgtcagtgcagattatattttaagcatggcggagatgggagtggagattgtgaacaatcttccacaggaggcggatgcaggagcatatgagaatgccttagcggatatcagtatggagggaattgattcttcctacgcctatcttgttgacacggacggcaccatgttatatcacccgaccgcggaaaagatcggacagccggtggagaatgctgtcgtgcttggcgtcgttgcagagcttgccaagggacaggtaccggtgaatgagacagtgacgtatgattttaagggcgttaccaaatatgcggcttacgcgatcacggcgaaccgtcagattgttgtggtgacggcggatgaagacgagatcatgaagccgctgaatcagatagtaagtaagattatgctgctgtcattggggatactggctgcagcgattgttctggcatacgtagtaagccagtttatctgcagaccgattcagcagattacaacgattattgtcgataccgcacagttggatttcagatcaaatccgaacggcgcaaagctgcgcagccgccgggatgagacgggagagatggcaaatgcggtacatgtgatgcgcaggaacctgcgttccatgattggcgatattgataccgcaagtaaccagatcacacagaatgtggatggtctgcaggagattaccaccacggtggatcacatgtgttccgacaactccgcgacaagccagcagcttgcggcaggcatggaggagacggcggcaaccacagtaacaatcaacgaaaatatcgaggttatcaagagcggagcggatgatattaacagtatggcgacggagggcgcacggacctcggaagcgatcatgatgcgggcaaatgatctacgcaccaagacagttgaggcaagcaccaagacaatgacgatgtacaacaacgtcaagacaaaggctcaggaagccatcgagggatcgaaggcggtcgataagatcaacgaactgaccggcacgatcatggagatctcatcccagaccggactgcttgcactcaatgcttccatcgaagcggcaagagccggggaggcaggacgtggatttgcggtggttgcaacggagatcggaagccttgcggatcagacgtccaaggcgatcaaggatatcggcacgattgtggatgctgtcaacgcagcagtttccaatatggcagaatgcttagaagagaccaccggattcctggagaataccgtgctgacggagtataaggaatttgagcaggtcagcgagcagtaccaggaggatgcggatactttcaagaccagtatgaacgacgtgagcgatgcgatggctggccttgccaattctatcgacgcgattgcacaggcacttagcggaatcaactctacagtgggcgagtcgtcgatcggcgtcagcgatattgcggagaagaccagcgacatggtggagaagacaggcaccacgcacgacatggtggaagagtgttatacttatgtggagaagctgcgtgagattgtgagccagtttgtattacagtaaataaaatatgatttgcagggaaaagggtatgcagatgttggagcgatgttgtgcatcggaatcacgtcggcataccctttttcacgcagacaggcataaacccgtccacattttcataggatgagttaacggcaaagcggtggacgtgctactttgtgggaaactcgatggatgggggcagcgcatatgcaggaatattatcgcggaaaaacggaagaacgagggagaaacgtgctcgaggatgaggagaaaaaatcctgggcggaaagttttctggaacagttaaacgatcctctgatctttatcctgtttgtggcggcggcgatctccctgctgctgcgggaatacggcgatatggcaattattctggctgtggtgctgttaaatgcgacggtgggagtgatacaggagggaaaagcgaaaaaatcgctggaggtgttaaaacagatgaccagcccgcatgcactgcttctggaaggggatgaagtgcggcagattccggctgccgatctgatcccgggcgatcttgtggtgctggaagccggctgtcaggttccggcggatcttgtgctgacagaagcggtgaacctgaaaatagaagaatccgcactgaccggcgagtctgttccggtcaacaaggatacggcgcagaaccgcatggcatatatgtcgacaaatgtgacctacgggcgcggcgtggggagagtatctgccatcggtatggatacagagatcgggaaaattgccgggatgctgaaggcggcgaaggtcgagctgacaccgttgcagaagcggttggcggacctcggtaaaattttgggcacggtgtccgtattcttatgtgtgctcctttttggcatggcaatcctgcaaaaacgggatgtgggagagatgctgattacggcgatctctcttgcggtggcggcggtgccggagggacttcccgccattgtgacgatggtgctggcactttccgtctcgcggatggtgaaggcaaatgccattgtaaagcgcctgccgagcgtggagacattgggatgtgtcagcgttgtgtgctcggataagacgggaacactgacacagaaccgcatgactgtaaaaaaatgttacgtgaacggcagagtgcatgcggtaaaagaactgcatccggccggcgaccggtattttttgcagggattttctctctgcaacgacgcatccctccacggaggggaacgccgcggcgatccgacagaattagcgctcttggatatggcggcagcgttcggcatacagcgggagacattggaggacaccatgccgcggatcgacgagattgccttcgattcagagcggaaacggatgacgacactgcatgagacgttggacggcagaatctctttcacgaagggatcgccggatgaaatcctggagcggtgccggtatgtgtggagcaacggcaagacggcggcgttttctgcggcggcgagagaacaggcaaaacggggacttgccgagatgacggaagcgggacttcgcgtgctggcgattggcatgcatcctaaagcggcacagatggaggagagcgggcttacgtttctggggatggcaggaatggaagacccggtacgccccgaggcggcggaggcggtggaacagtttgcacgtgccggagttcggacgatcatgattaccggggacagggcggacacggcgcttgcgattgcacgccagctcggcattgccgagcggagggatgaatgtgtgacgggcgaggagatggagcggatggacgaacagatgctggcggcgcggatcagtagaacccgggtgtttgcccatgtatccccggagcacaaggtcagaatcgtgtccgcatgcaaaaagaacggggagattgtcgctatgacaggggacggagtcaatgatgccccgtcgttaaaatctgcggacgtgggaattgccatgggaatggcgggaacggacgttgccagaaatgcagcagatatggtgctggcggatgacaattttgcaacgattgcaggagcgattgcacagggacgcagcatctatgaaaatatccgcaagtcggtgctgtttttgttgtcatccaattttggagaaattatcacaatgctggcagcagttgccatggggctggtatcgcccctaaagtcaagccatattctatggatcaacctgattacggattcgctgccggcactggcgctcggggtggatgtggaagaacagaaggattacatgaaccgtccgccgagacacagggatgagagcctgtttgcgggaggcggctggggatgcacctgtttctatggtcttttgatcgctggaatcagtatgcttgcctttttgcaggtgccggtcggtatgatcgaaggcgccgggatgacattgacacttccacacctgcaggcggtgcttaaagacgtgcaggtgttagcacgggcgcagacctacgcatttaccgtgctcggcatggcgcagttattccatgcggtcggcatgcgcgatgtggagacttcggtgttttgcatgaatcatctggaaaatcgtctgatgttggcggcgtttgtggtgggaattggtcttcagttgatggtcacggaggtaccgtattttgtacagttgtttggaacctgcagacttaccgctctggagtggacgaagctgcttggacttgcggcaatgccgctgctggcacatgaactgttggtgctgttttcctgcgcgggagaggtaaaggatgcgttaaggttgcagggagaggattgacaaaggcggcgtcggactgttatactccatacaatcttaaataacagaactgctaaaggggagtagttttaaattgcagcgtcaacatacgcggtcttggacctggcgctgtgtaccatgaagattacccgtggttatgagacttttagcgcggaaagtatcgcagagatacatttcgtgctggaagtctcttttttaattttaagaaaacaggaggcagaaatgaaagagtggtatcagatttcagcggaagaagtgaaaaagaagatggagacctcagaacatggactcacaacggaggaggcggcaaaacggctggcgcaatacggggagaatgtgctggtggagggaaagaaaaagagtgtttttgcggtttttttcggacagtttgcggatcttctcgtgggaattctgattgtggcagccgtgatttccgcctgttcggggaatccggagagcacctttgtcattctggttgtgatcgtgctcaatgcgctgctaggaacggtccagtatgtaaaggcggagaagtcgctggagagtctgaaggatctgacgtcgccgaacgcgaaagtgctgcgctccggcgtgaaggtggagattccggcgaaggaagtcgtgccgggagaccttctgctgctggaggcgggagacatggtggcggcggacggcagaatccggcgcagctattcactgcaggtggatgagagctcgctgacgggagaatcgacgaatgttgagaaaagagaaggtgtgatcgaacaggaggcggcgcttggcgaccgcgtgaacatggtgtattcgggaagtctggtgacttacggaagggcagaggtttttgtgacggagactgcgatgaacacggagatcggtaagatcgcaggacttttaagcaatgcgaaggaaaaaaagacgccgctgcagattgcattggatgattttggaaaaaagctgtcatatctgattctggctgtctgtgcgctggtgtttggtctgtccatgtaccgggatatgccgcttctggatgcgatgatgtttgcggtcgcgcttgcagttgcggcgattccggaagccctcggttcgatcgtgacgatcgtgcaggcgatgggaacccagaaaatggcgagggagcatgcgatcatcaaagatctgaaggcggtggagagtctgggctgtgtgtcggtaatctgttcggataagacaggcacgcttacacagaacaaaatgaccgtgcagaagatttatctggatcatacggcgatcatgccggaggcgctgcagatcaacgatcagcttcatcgttatctgatgtatgatgcgattttaaataacgatgcgcgcatggatgacgggaaagtgattggcgacccgacggagtcagcactgctcgagatggtgcggaaatgtggcgtggatgatgatttcttacggggagcaatggaacgacagcaggaactgccgtttgattcggaccgcaagctgatgagcacggtctatgcgctgcacggtgtaccgacactgctgaccaaaggggcgccggacgtccttttgaagcgcgcggtctatcttagggagaagcagggcatccggcggatgacggaggaagaccgtacggagattttagagcagaatcaaagattttccggggaggggcttcgtgtgctggcgtttgcttaccgggaactgaaagagagcgaggagctgacgctttccggggagtgtgattacatttttcttggacttgtggcgatgatcgacccgccgcgcgcggagtctgcggcggctgtggcagatgcgaagagagcgggaatccgaccggtcatgattacgggggaccataaagtgacggcgacggcgatcgcaaagcagattggcattttcggggagggggatatcgcactggtcgggcccgagttggacgccatgccggataaggagctggaccatctgatcggacacatcgccgtgtttgcccgcgtctccccggaaaataagatccgcattgtggaagcgtggcagcgcagggggagtgtggtcgccatgacgggagacggcgtcaatgatgcaccggcactgaaggcggcggacattggcgtggcgatgggaatcaccggaaccgaggtgtccaaagacgcggcagccatgatcctgaccgacgacaattttgccacgattatcaaggcggtcgcgaacggaagaaatgtctacaagaatattaaaaatgcaatcctgtttttactttccggaaatatggcgggaatactggcggtgctctacacctcgcttgcagcacttccggtcccgttccagccggtgcatcttttgtttatcaatctgctgaccgattcccttccagcgcttgccatcggtatggaaccggcggagagagatgtcctcagcgaaaaaccgcgcaatccaaaaggcggaattctggaaaggcgctttatggcgctgcttctggggcagggggcgctgattgccgtctgtaccatgatttcctttgaggtgggattgaaagagagtgcggcgctggcgagcaccatggcgtttgcgacactgacacttgcacgcttgttccacgggtttaactgcagaagccgtcactccattgtaaaaatcggattccggagaaaccggtacagtctgggagcctttgcgctcggtgtgctgcttttggcactcgttctgtttgtgccggcactcaaaaccctttttgaggtggagacgatgaatggcatgcagctgggctgtgtcggtgtgatggcggtgctgccgacgttcgtgattcagaacttcaaggtggtgggtgaagtgtttgacagagaaaagtaggaagaaacagcttgtgaaaacgttaccagtcctgtatgataaggaaaaaggatacagaaaatctgacagaaagaggggcgtttggatgagacgaagaggaaagagagaactggcggcactgctggcagtggcgttgcttgctggaagtgcggcgtgcggagcggatgccggggagaaagacgcggcaacaggtacggcggaagcggcagccgggcaggacacggagacggcagccgggcagggcacggatgcgcagacgggagcacaggagaacatggaagagacggcgctgtctctgatgcgggaggtaaacccggcagaagctgcaggaacggatgatctctaccggagctggtacgaggtgttcgtttacagcttctatgacggcgatggggatggcatcggagatcttccgggactgacggagaagctggactatatcaatgacggtaatccggcaacggatacagatctgggatgtgatgggatctggctgatgccggtgatgccggcgacgacttaccacaaatatgatgtgacggactactgtgcgatcgatgagcagtatggcacaatggaggatttcgagacattcgtgaacgcatgccatgagcggggaatccgtgtcatgattgattttgtgatgaatcatacttcgtctcagcatccgtggtttcagacggcggcagagtatctgaaggatctgccggagggaatggagccggatacagaggcatgcccgtatgtggattattatcatttttccagggagaaaggcagcggatactgccagctggcagggacggactggtattatgaggcacagttctggagcgagatgccggatctgaatctggagagtgaagcggtgcggcaggagtttgatgagattacagacttctggctggaaaagggcgtagatggtttccgtctggatgcggcaaaagagtatgagaccggaagcatcgactcgaacatagaaattctatcctggtttaataatatggtaaaagaaaagaagagtgatacgtatattgtgacagaggtgtggtcggatctggagacatacgcacagtattaccagagcggaattgacagcagctttgactttacgtttgcagacaaggacggtgtgattgcgaaggcggtcaagggaacgagcggtgcctcttcttacggaaaagcgatcgtgcggctgcaggacgcgctgggaacttacagtgacagctatatcgatgcgccgttttacaccaaccatgatatgggaaggggcgcagggtattactccggcgatactatggaggcgcagaccaagctggcgcaggcgatgaatcttctgatgtccggaagcagcttcttatattatggagaagaactgggaatgaaaggcgccggaaaagatgagaacaagcgtgcgccgatgtactggagcaaggatgccggtgcagaggggatgtgtctcggaccgcaggatatggatgcgatcacgatgatctatgacagtcttgcggagcagcaggacgacggcaattccatctactggtatgtgaaggaggcgctgcgtctgcggaatgcttatccggagatctcgcacggaacggcagagttccttgaaaatctgtcggatgatgcagtgtgcgtgctgcgcaagagctggcaggattcctcggtgatcgtcgtgtttaactgcacgaaggacgagcgcaccgtggatctgtcacagatatctgcagacagtgaaagcggggatttgaagctggcaggagaactgctgaccggaatccgtgcggcttcctggcaggatggaacgctgacgcttccggcgtacggtgttgccatcctgaagtagagatctgaaaaaacaatcagccgctctgctgccggcagcatcaggagagaaaacgatcagtcgttataattcagaagaaagtccgcaaactgtaaggcggcgtctaagttctgattctgatagagtatgccgaaatagcaggaatcataatagttgtacttgtgaagccaggcattgtcggtgagctcgatcgcacagggataggaagcgacggcaccgtcctcggtcgtgtagatgagatgatcctggtagcggtccagcagttcgtcggataatacggtggacagatccataagagctccctggttggcgtaatcgagatattcgccgccggttccgaagaagagatcctgtccgccggctgccagcatcagcgtcagcacctgcgtgtcgttgtaggacgtggaatactcgccgtccgagaactgtaaggacgatgtgagggagacggaatcttccttcgggtcgtagccgcaggcttcgagaaattcatcgaagcccttgctgtcggcggttatggaatcgttgcagttcatcatgatgacgtttaacagcgggtcgcggtaggtcgcgtaatgatagatgaggtaaatgacaaagcagagcgcagcgatcgcagcggcgatcggccacttgtaataatcccagacatactgcactttcgccttgcgggaaagtgaatgaaaatcagcctttttctccataatggtactccgtttctaaaatgaactagtacaagaataacatagaaatggaaggttaaaaaggaaaaaagaatgaaaaaattataaaaaaacagagcagtgagagaatctctccatctgctctgttctttttcgctctccaattaagaaaagcgggtgatgggaatcgaacccacgtatccagcttggaaggctggtgttctaccattgaactacacccgcatgaagtgcccagttccggaatcgaaccagagacacgaggattttcagtcctctgctctaccaactgagctaactgggcgtctcacagaaatttattttacaggaaagccattaggatgtcaagaaaaaagttttgtaagaatcttaaatttttgaaaaataaacacaaaaggtcttttcgggaaaagggatacatgctaaaatatagcacagtgagcagtttttggaaggaagaggcgcaggcgggatactgcgcggaaagaggttttacatgcacgagaaattagtgattgttccgagaaagaaatctacggtgaagaagattttaaacgtggtatggtttgtgttggcatgcctgtgctttttatttgcgatgtgggtgccgattttatttgcggtgccggcaattatttttgccatcatctggtattttcaggcattccgctctgatattgagtatgagtacacctattatgacggagagttccgtttcgcgagaatcaaggcgaagcgcaagagaaagggacttggaagagttcagatggaagatgtccttgcactggcaccgaagggggaccggagtgtatacaagtatgagaatgataattctcttgcctgtaaggatttgacttccggcgagagcggcacgaagatttacgaactcgttttcaaaggcgagaagggaatcaaccgctatgaatttgaaccggatgaggagatgctcgacgcagtcatggtgaagtatccgcgtgcggtcataaagtagaaaacaaaaaaggtggcccggatcggtaaagcgatcgggacacctttttatatcatatatgatgaatcaggacagatccgtggatcagtcttcaatgaaacgcatccggctgtctgagatatcctcacgggcagaggagtgaatggagacatccttctggcgcatgcatttggcacataaagtcccgaaagagatcggtgcgccgcatctggtgcagtgcatggtaatcgtgttcagatggtcatccttgtactcaatgcgcccctcgcggatccactttttgacctgcatatgcgggatgtggaagtgctgtgcgacatcgtattcatttacatcgttctcacggatgtactctttgacttcgcggaagagcttctgctcgatacacgacgggcagagattctctttatatgtcaatggaagcggtcgtttgcattcttcacaatatttatagttcccaaataaatcctgtggttgttccatcgtctgtcacctccggtagtatgctgccacatccgtccgccgcatgcaggcatgggcgttcgtctttactccatgttcactgtttatagattcattataccatgaacgacggtgaatgaaaactttttatcacgtagaaaagaaaagaaacttagcagaagcttagcggggaggaaacgatttgaaactgtttcatttgtcggatcttcatataggaaaacagctgcatcactacaatctcgcggcagagcagcgcaagacactggcgcagattgtggcgcttgcaaaaagcgagcacccggatgccatcctgattgcgggagatatttacgacacaccggtgccttcggcggaggcagtgtctgtctttgatgcgtttttgtcggcattatgcgagatagagccgcagattgcggtcatgatcattgcggggaatcatgacagtgcaagaagaattgattttgccagcagtattcttgcaaaacatgaggtgtatatcgcgggacttccgccgatgcaggagggggagacgatccgccgcgtgacgcttgcggacggatacggtgaggtggatttttatctgcttccgtttgtgaagccgggttatgtgagaaagctgtttgacgaggaaataaaaggctatgacatggcggtaaggcgcctgattgagcgcgaggagatagatccggcgcggagatgcgtgatcctgtcacaccagttttatacggcgggcggaaaggagcctgcgacctgtgactccgaaatccactatgttggtggcgttgaaaatgtcgatgccggcgtgcttgcgccgtttgactatgcagcattgggacatatccaccgcgcacagcatataggagcggaaaaataccgctattgcgggacgccttttccgtattccattagcgaggcgggggaggagaagagcgtgacggtcgtggaactgggagccaagggacagccgcccgtgatccggcagattccgcttacgccggtgcgggaggtaaaaaagctgaccgggacgctgcatgagattttggagcaggcggggcaggaggtctgccacgcatttgtgagcattaccctcacggatgacgtggaggcgttccagccgaaggagcgtctggaggaaaaatacgaccacatcctggagatacggattgacaatgcgcggacgaggaagctgttgtcggacacggaagagcagcttgccgaagtgcggccggaggaggcgtttgccatgttttttgcggagatgaacgggagagagatgacgcctgaggagcgggaactgatgcgtcaggtgattgcgcaggaaatggagggggacgaatgaagcctgaaaaactcatcctgtcggcgttcggatcgtatgcgggacgcacggagattgattttacggtgcagacaggcggactatttctgatcacgggggataccggcgccgggaagaccacaatttttgatgccatcacctatgcgctgtacggggaggcgagcggcggaggcagaagcggagccatgatgcggagccagtatgccaaaagtgtgacggagacctatgtggaattctcttttttgtatgcgggcgagtcataccgcgtgcggagaaatccggaatataagatcgtaaaagaactgaaaaacggaaaactgcgggagcagaaggttctggcagttgtggaactgacgctgccggacggaacggtgtatccggaaaaaaggagccagaccgatgcgaagatcgaagagctgatcggactgacaaaggagcagttcacacagactgccatgatcgcgcagggcgattttttaaaacttctgtatgcaaagtcggacgaccggaaaaagattttctccaaattgtttcacacggatgcatactggagaatccaggagaacttaaagcggcgttcactggagatggaccgggtgcttgcggaaaatgagcgggctgccgagcaggagagggcgcgcgtgattctgccgcgcgaagaactgaaagaacttccgcttccggaagcggtggagcagatcggtatctgggagagggagctgacggcttcacaggagaccgtgcgggaggcgatacggaggctgactgcggaaatctctaaggcgaaggaagtcaatgaactgtttgaagggttaagagactgtgaacagcaggtacagaagttaaaggaagaagagcccgtggaagcgcgccggaaaaaacagctggaggcggcagtacgtgcggagagggtgcatgtgaaggaattgcgctgcaatgagcgtctggatgagcggcggcagtccgacgagacggtggagcggatgaagagccttatcgcggaggaaaaggaagcacatggcaggcaggagcaggactttaatacgcttaagatgcagagcgccgatgcggcggaagccgacgcggagaaaatgctccgcatccgggaacagcttccggtgtatgagcgcctgggagaggcagtagagcgggaacagcaggcaaagcaggcgtacgagtcggcgaagcagtattatgagcgtgcggtgcgggaaggagccagccggctgctcgcggaaaaaaacaggcagcttttgctcgaggaaaagtatgtcagcgccgcaaaagcgtgggagcgggcatccgcccggtccacggaggcgtctgcggaatatgagcacgtgtaccagctgtttttaaaggaacaggcgggaattctggcacagaatctgcgggaggcagagccttgtccggtctgcggctccctgacacatccgcatccggcgtcccttgctgagaatgcggtcagcgaagcggcggtaaaggcggcgaaggaacagcgggagcaggcggagacggcgcgcgatgctgcgtatcaggaatttgacgggcagaaaagcgcggcggcagagcaggaactgcgtctggagcaggcgaagcagcagttcttggcgcttgcgggagatacgtgcggtgacagagagaaagaactttatacgtttgccgcacagcaggcggcagaagaacctgcagcaaaaaagaggtctctgacagagcgtggacggcaggcggagcgattttcacgggaggggaaaaaacatcccggggaaacgggagaggcggtggaccgcctgaagcttgagtcgctcaagcgcgactgggaagaagaccagcgggaaacggcacggatccgcgcagagttatcatttgagacgaaagaaagggcagaggaagcgctgcagcagctgacggatgaggcagaccggcgtacgaagcgccttgctgatgcagaggaaacactgcaaaagaaaaaggaagacatttccagacaagagggaatgctgacgcaggagcagacgaagaatgccggacttgtgcaggagtgtctggaattggagaaagaataccggcaggcgctgcgtgatgccggattttcttcggaggaggcataccacgaagcattccttacagagagcgggcgggagacgctcgtgcagcagtctgaggcatacgtccggaatcgcgtggaaagtgagggcaggcttctgactatgcagaagctgaccgagggaaagcaggagattgggatcttggcatgggagacggaactggaggcgcaaaaacagcgccagcaggagcttcatgaggagattcttgcaatgcacaccgcatacgagacggatgcgaaagtggtggagcgctgcagggaatatttcgccgcacacgagcggctcgatgcggaaaaccaggtgctgaaaagactgtactgcacggcggatgggcgcctggcgggctcggcgaagattgattttgagacgtatgtgcagcgccggtatttccggcaggtgatctacgaggcgaacagacggctattgacgatgagcggacatcagtttatgctaaaactgaaagagacggaaaacagcggacgcaaatccaacgaaggtctggatctgtcggtgtacagtctggtcacggacagtgagcgcgatatccgtaccttatccggcggcgagtcgtttctggcagcgcttgccatggcgctgggactttcggatattgctatccgcaaggctggggccgtgcatctggacatgatgtttatcgacgagggattcggtacgctggatgcgcagtccagaaaacaggcgattgaagtattgtcacagctcgcgggaagcgagcgcctggtgggaatcatctcccatgtgacagaattaaaagaacagatagaacacagactttatgtcacgcgcacggagaacggaagcgaggcagtctgggaggaatagcagtggaaaagtatgaaaacagacaggaatgtccgattggtgtgtttgattcgggagtcggaggaatcagtgtgctgcgggaactggtggcacagatgccgaacgagaattatatcttttttggggattctaagaatgcgccctacggtacaaagacgctggaggaagtgcagaagctgacctgtgcggatgccgaatatctgctgtcacgcggcgtaaaggcgctcgtggtggcatgcaacacggcgacaagcgcggccatccggatccttcgggaaaaatatgcggatatgccggtaatcggaatcgagccggcattaaagccagcagtgcacgcgggcggacacccgcgtgttctggtcatggcaacaccgatgaccctgcgcgaggagaagtttcacgccctgatgcagcggtttgagtcggatgccgagattctccggctgccgtgtccggggctggtggagtatgtggagcagggcgtgctggagggcgcagaactcgaagcgtttcttgcaaatctgtttgaaccgtaccaaagccatccggtggattgtgtcgtgcttggctgcacgcattatccgtttgtgcgggagacaatccagaagcttctcggagccggagtgcagatctttgacggcggagcggggaccgcgcgggagacagaacgcaggcttaaggattgcggtctgtgcagtggcagagcgcagcaaggaaccgtggaattgtgcaacagtcttgcgtcggagcagatgaaacagctggagatccggctgctccagtcgggcacggtgcaggcaattataaaaaaatagaaataaaatattaaagaaatctaaataacattgaacgtttttttagaaagctttatgaaaatcgacatacttcggacacattttttccgtatactaacatcatcgaaaggagctgaggacggtttcccagagcttcgttcccagcagctcagagatgtggaataaaggtcatatttctgcagaacctttcggtgaagattcctttatatagattaacattttcataactaaactcctcgaaaaacccccgggacagagatgtcccgggggtttttcattggggggaacatacaaagaatgtaaaatgcagtttttatatgttgaacttactatgcttgtgatataatgaatcttgacagattcatattagaagttcctgcggaacttcagatgcgcagaaagcagcgcaaaaaaagatgatatattcgctggaacgccggcaggcacaaaagagagggggacgctggtggtagaagataaggtgacggggaagcgtatgattgctcacatcaatgcgagcggaaagattcagacagtaaaaagccattctgaggggaccgcatgtctgacacagcagtttgcggaggagttcggttgtggaaaacagggatatttttgcggacttcttcacgatattggaaagtattccgaggcatttcagaggcggattgcggatccggaacacacggcaaaggtggatcattcgactgcgggggcggttgaggcgatgaaaatagcaaaagaaaacataccgcttgcaatgacgattgccgagcatcattctgggttgttgaacggaggcgtctaccggatttccaataaaggagacggcacgttttttggaagaataaaaggagcggaaagtctgccggattatgcggcatggaagagagatatcgtaccggaggatgtgaatattcctgcattttgtagggatggaagcaatccctgttttacgatgtctttttttattcggatgatgtattcctgcctggtagatgcggattatctggatacggaagcgtttatgaaggagaatcaggcagtcaggggagaatatgattccctgaaggttttggcagaacgttttgacaaccatataaaacaatggctggaaaaaacggatttcaaaagcgacaaacagaaaatactctgcagtataagaaatcaggttttgcaggattgtatgagcaaaggaagtgaattgccgcccggaatctatacgctgacggtacccacgggaggcgggaaaaccacggcatctttgggctttgcactgcggcatgcgatacaatcaaagatgaagcggattatttatgtgataccgtacacatcgattatagaccagaatgcagaggtgttccgctctattttaggagagaaaaatgttctggaacatcattccggaattctctacgatctgacggaggataaggcggagaatgaagcggcataccgcaaggctctggccaccgaaaactgggacatgccggtgatcgtgacgactgcggtgcagttttttgaatcgttgtatgcgaaccgcagttcaaaatgcagaaagcttcataacatggcaaacagtgtcattatttttgacgaggcacagacaatgccgattccatatctggaaccgtgtgttgcggcaatcgcagaactggcggcgcattaccattcaacaatcgttctttgtacggctacgcagccggtattggatgaaatgatccaaaaatatataccgcagacgcaggtaagagaaatctgtgaacatacagatattctttttcaaaaactgcgcagaacatcgattgttgcagccggcaatatggaacgggaaaaattgatcgactgtctgactgcgcaggagcaggtgctttgcattgtaaacagtcgaaatctggcacaggaactttttgaagaaattccgagagagggagcattttgcctcacaacattattgtacccggagcatcgcaaagagaaattgcgcgagatcaaagagagactggaacatcatgtgccctgcagggtgatcgctacttcacttgtggaggcgggcgtagatctggattttccgtgtgtatatcgtcaggagaacggactggatgcactcatacaggcggcgggcagatgcaaccgggaggggacgcattccccagaggagagcaaggtatatctgttcggtttgaaaggcgatgcatcggtatattttgcacagaacatcagcgcgttaaggcagaccctgcgttgttacgaagatccggcagcgccggaggcgatcgcattctattttaagcagtatcgtgagattctggggagagagaatctggatcaaaagaagataatggatgcatttactgccggaaaaggaatcaatggggattgctttccgtttgcaacggtggcaagggaatttcatctgattgagagtgagacacagacgatttatattccggtcggtgaagcggaattgtggatagaggagatggaaaagggaaaggtctcaagagaacttatgcgaaagctggggcagtatgcggtgaatgtatatccgaatcatttaaaagcattgtacgatgccggctgtgtggaaggaatcggagaggggatgtatgtgcttcgggatatgaaccagtatcatgaggataccggacttcagatggatgtgagtacaggatatggattgttcggataaaagagtggtcaaaaggcggcagaaatctgccgccctgatgaaagaaaaacatattaaatatttcaatccacacttataaagtgacaaaatcagtgtatacaaatataacgtttttttcaataaaaaatgtattgacaaacataataatatattatattgtataaatactttaaaacatattaaatgaaaaaataaatgaaaggaggaatgatatgtggcagtaaaaatggaagtgtgggggaattttgcatgcttcagccggccggagatgaaggtggaacgcgtcagctatgatgtgatgacaccgtcggcggcgcggggaatgctcgaggcagtatactggcacccaggcctgcagtggcatattgacaacatttatgtgttggcgcctattcagatgacaaacatacggagaaatgaggtgcagtccaaggtgctggggagcagtgtaagagcagctatgaccggcggacgcacagaactgtatattaacacatcaaaggatattgtgcagagagcatcattggttctgcaggatgtcagatatgtgattgaagcacattttacccttacagagaaggcggcagccggagataatccgggaaagtttcaggatatcataaagcgccgcctgagaaagggacagtgctatcacgaaccatattttggatgtcgggaattcccggcgaatttcaaggagtgggagggcggagagattccggctattcaggagacaagggatctcggctatatgttgtgggatcttgacttctcagatccggcaaacattcgtccgctgttctttcgtgcaaagatggaaaacggcgtgatccatgtggcagattgcgaggtgctgcgatgattttacaggcattggtggaacattatgaagatttgttgaagcaggggcggattgcaaagccgggttggggaaaagtaaaagtttcctatggactgaatctggatcggcagggacacgtactagggttgatcccgttgaaggtggcgcaggagacgggaggcagcaagaaaaaaacggtttttgttgcgcggatgatggaagtacctcatccggagaagagatccgtggcggtttgcccgaactttttgtgcgacaatgcgacctatattcttggtgttgatgaaaaaggaaaaccagagcgaaccagtcagtgctatgaagcctgcatggaaaagcacatggaattgctttctgatatccacacgccggcagcagaagcgatctgtcattatttcgagtattggagcccggatgcggcgcgccagtgtactgacatagaggataactggagcgatctgatggcaggagtaaatcttctattttattatgaaggagaagcagtgacagaggatcctgcaatacgtgaagcatggcagcagttttatgacaggaaggatgaaagcgggcagacgttgtgtctggttaccgggaaaaaagacaagcttgcagtgctgcatccgagcattaagggggttcgcggcgcacaggcgatgggagcgtcactggtatcttttaatgcagcgtccttctgttcctatgagaaggaacagggtgccaatgctccggtgggtgagtatgcggcatttgcctacaccacagcgttaaatgaacttctgaatgaccgggctcacacgggaactatcggggatacaaccgtggtatgctgggcggaaggaggagagagcctctatcaggatgtcggtatgatggcgatgttcggtctgacagatgagagtggtatgacagatggcgaacttcgggcaattatcgggaaggtggcaaacggggagccggtacagatcgaggatatacgactggatcccgacagacatttttatgtgctgggacttgcaccgaatgcggccagactgactgtccgattttttatgagggattcttttggcactatgatccggcatgtcaatgaacatcaggagcgtctgcggattgttaatgcgcggcaaaaggagtatcccatcattccaatctggaaattgatgtcagagaccgtaaaccaaaatgcgagagacaagtctccgtcaccacagatggcagcggatacgctaaaagcggttctgacaggcggaaagtatccggcatcgctgctaaacgccgttatgttaagaatccgggcggaacacaggataacacgagagcgagcggctatgataaaggcctattatctgaagaatgagaacaaagactgtcccaaggaggtattgcaggaaatgataaatgaggagagcaaaaatgtaccatacacactggggcgcctgtttgcggttttagagcatttgcagcaggaagcgaatccaggaattaacacgacgatcaaagacaagtacttcaattcggcagcagcgaccccggcacagatttttccgctattgctgaatctggcgcagaagcatctgcggaaactggcaaacgaaggacacaaagtttattttaaccgacagattgggaaacttgcggaagtgattggggagagtttcccaaagcgtttaaatctgccggaacagggagcctttcagctggggtattattgccagacacagaaacgatatacaaagaaggaggaaaactaagatgggagaggcaattaggaacagatatgattttgtagtactatttgacgtggagaatggaaatccaaatggagatccggatgccggcaatatgccgagaattgatccggaaacgggttacggtctcgtgacagatgtgtgcctgaagcgaaagatccgcaactatgtggagacactcaaggaggatacgaccggatataaaatctatatcaaggacaatgtgccgttaaaccgcagtgatcttggagcattccagtcacttggcattgacgaaaaggagattaagaatttaaagaagacagatccaatgctggacgtaaaggttcgtgactttatgtgtcagaatttctatgatattcgtacattcggagcagttatgaccacttttgtgaaagcaaatttaaactgtggacaggtacgcggaccggtgcagatgggatttgcgaaatccgttgatccgattcttccacaggagatcacgattaccagagtggcaatcacgacggaggaggatgctgccaaaaaaggaacggaaatgggaagaaaatatattgttccgtatggtctgtaccgggtagagggatatgtgtctgcaaatctggcgagaaaagtgaccggtttttcggaagaggatctggaattgctctggaaagcaattctgaatatgtttgagaatgatcatgcggcggcacgcggcaagatggcagtcagaaaactgatcatttttaagcacgacagcgaacttggaaatgcaccgtcttataaattgtttgaagctgtcaaggtggcaagaaaacctggagttgatttggcaagggcgttttcagattatgaggttacattgccggagcagctgcctgagggagttacctgtacctgtatggaatagtattgcgtggctatcgcagggagaaacatatggaatatcaggaggaggattatttattattatcgggaattcagcatttcgttttttgccgcagacaatgggctctgattcatattgagcagcagtgggaagagaatgtacggacatttgagggaagggtcatgcatgaaaatgcgcacaatgcggactttcacgaaaaaagaaacggggttatcatggtgcgggcgatgaaggttttctccagagagatgggaatcagcggagaatgtgatgttgtggagtttcatccggcaccggagggcatcacattagctggacaaaagggaacgtacattgccgtgccggtggaatataagcgcggaaaaccaaagccgcacaatgcagatgaaatgcagcttatggcgcaggcaatgtgtctggaagagatgcttatgaccagaattccaaagggctatttgtattatggagaaacgagacgcagaacggaagtgctgtttacagaggaattgagacagagtgtacggtcttgttttgaagaaatgcatgcatattacagcagaaaatatacaccgatggtaaagacaggcacatattgcaggcagtgttccttaaacaacatctgtctgccggaactttccggagcacagcctgcggatgcctatgtgtcggagatgttaaaggaggaattgcaatgaagaaattgctgaatactctttatgtaacaacaccggatgtatatcttgcattggatggagaaaacgttgtcgtcaaaaaagaggatcgggtggcaatgcggataccgattcacaatgtagaagcaatcgttgcgtttaattatgtaggtgccagtccggcgctcatgcgcaaatgcaatgagaacaatgtgaatctgagcttttttcacaatgattcgttttgtgccagaatgatcggacaggaaaacggtaatgtcgttttgcggaaaatacaatatcggctgtcggagcgggaaggtgaaagtcttgcgattgcaagaaatatgattctcggaaaggtacataatgagcgttatgtacttgaacgggcaatccgggatcatgcattgcgccttgatacagaaaagctaaaagatgcgtcggagcagttaaaacagtatctaagagcggtgaaagacagtggtagttcggaggaactgcggggatatgaaggaaaagcggcaagcacttattttagtgtatttgatgaactgattcttcagaacaaagagagcttcgtatttcacggaaggaataaacgtccaccgctggataatgtcaacgcaatgttatcatttacgtatgcgctgctggtaaacgagtgcgcaggcgcagcctattcggtcggacttgatccttatgttggatttttgcataccgaccgtccgggaaggcagtcattggcgttagatctgatggaagaattccgggcacccgtggcagaccgttttgttcttacaatgattaacaagcagcagatcaatgcaagagggttcagaaaaatggaaagcggagcggttgttatggatgatgacacacgcagagtgctgatacagaactggcaggaattaaagagtgaagagatcatgcatccttacctaaaagaaaaagtagctgtcgggctgctgccatatgtgcaggcgatgctgcttgcccggtatctgcggggagatatcaatgcatatccaccatattttaaacggtaaagataaactgtatgctgtttggaaggaaggtgagttatgttagtgctgattacttatgacgtgaatacacagactgcggcgggagtacgaagacttgcccgggtagcgaaaatctgtacgaattacggacagcgggtacaaaattctgtatttgagtgcattgttgatcagacgcagtatgtcatgttgaaaaagcagttgaaggatatcattgatgtggataaagacagtgtgaggtactatgtcatgggggaaaagtataagagtaaggtggaacatatcggtgtgcaaagggcatttgatgtcacggcgccgctgattatctgagagtttttagagtagtgcgaatgtaaagtgtacataaatacagcggaacattcgcgcacaatttatcagtgcaaatagcacaaaatcaagttatcgtctgtggaaaacgtgaaagagtaaaggaatttttggaagaaagcgttgaaaacaggaggtcacaaaggaattttatgtgtatatttgctgtcgctccctgtgaggggagcgtggattgaaattactacgggcgccgctattggacttgtgttcatgtcgctccctgtgaggggagcgtggattgaaatcctggtcttaagtggcaagatacatacttgatcgagtcgctccctgtgaggggagcgtggattgaaatgctataccggcacacaggtgctcactccacagcgagtcgctccctgtgaggggagcgtggattgaaatgctaacgctttagttgagcagatcatggagcagagtcgctccctgtgaggggagcgtggattgaaatacggcattgcacggcgtaagaatggcatgtacgggtcgctccctgtgaggggagcgtggattgaaatgtctggatggtaatctcttttatacatattatacgtcgctccctgtgaggggagcgtggattgaaatagatgtagagctggcacagacggacgcaaagtatgcgtcgctccctgtgaggggagcgtggattgaaatattgataatagagacaatcttatcgccaatattcgtcgctccctgtgaggggagcgtggattgaaattcataatatccataaaaccgccccccctatgcttcgtcgctccctgtgaggggagcgtggattgaaatatcaagccatttttccatgtttttcttgtctggcgtcgctccctgtgaggggagcgtggattgaaatgctcactctttttttgatgactcttaccatgatggtcgctccctgtgaggggagcgtggattgaaatgcataaccataatccttgtactcctcgcgcagctgtcgctccctgtgaggggagcgtggattgaaataaaaaatgatgatgacggattccaacgcagcaatgtcgctccctgtgaggggagcgtggattgaaatgctaacgctttagttgagcagatcatggagcagaggtcgctccctgtgaggggagcgtggattgaaattgttataaagtgacctaaacgtttagctcctgtgagtcgctccctgtgaggggagcgtggattgaaatctgcgagcagggtcgacgagcacatcaagacggagtcgctccctgtgaggggagcgtggattgaaatccctgattccattgaaagctaatgaacaggaaacacgtcgctccctgtgaggggagcgtggattgaaatatgcagatgattgatatggaagcaaaggttgaggtcgctccctgtgaggggagcgtggattgaaatataggaattcatgtggcttttaacgctttcttcgtcgctccctgtgaggggagcgtggattgaaatcgctatatgcctagcttgtgccgccgcttcgatgtcgctccctgtgaggggagcgtggattgaaataaaacttaacgtcgattcgccgttcggttcgtcgtcgctccctgtgaggggagcgtggattgaaatctgtcgtgtgcattttataatggacgtttggacaagtcgctccctgtgaggggagcgtggattgaaatatattatctagattggttactccatctttgacagtcgctccctgtgaggggagcgtggattgaaattcaatctgctgaatccgctgctgaattgcagatgtcgctccctgtgaggggagcgtggattgaaatcatattccgacattgaggatgacaggcttgtggtcgctccctgtgaggggagcgtggattgaaatagtctattgcagacgattttgacggcttgcaagagtcgctccctgtgaggggagcgtggattgaaataacctgctcctcgtcgttatcctgtggcgttgtcgtcgctccctgtgaggggagcgtggattgaaatgattgaattatctctttgataactccaaacgccgtcgctccctgtgaggggagcgtggattgaaatagaagttataggtgctggcaagatttaccgtgtctggtcgctccctgtgaggggagcgtggattgaaatatgttgtccaagttggttactccgtctttgacagtcgctccctgtgaggggagcgtggattgaaatatgcagaggtattcatcccagtttgccgccgcaaaagtcgctccctgtgaggggagcgtggattgaaataaatagcgtcatacgtgacaagctacgcccgtttgtcgctccctgtgaggggagcgtggattgaaatcatgtacataatcgaccgtaacatgagtttgttttgtcgctccctgtgaggggagcgtggattgaaatcgagatcgacggagatcgtcacgtttgtctgatcggtcgctccctgtgaggggagcgtggattgaaataaggtttccgtcagctattgcctgtgcgatctccgtcgctccctgtgaggggagcgtggattgaaattccgcctccgagcatcttaccgcccatctgtccggtcgctccctgtgaggggagcgtggattgaaatcttggagatgccgcagttcttcagaatagccatgtcgtcgctccctgtgaggggagcgtggattgaaatctgtcggcgcagaattccagggcgtcttatatggtcgctccctgtgaggggagcgtggattgaaataactcatcgccacggagcacgccagaccctaacgccgtcgctccctgtgaggggagcgtggattgaaatactaagcgcaagttctgacagccagtacgccatcgtcgctccctgtgaggggagcgtggattgaaattatggctccatgcatcatccattgcccgatgcccgtcgctccctgtgaggggagcgtggattgaaattttcagatgtttgcggtgtttttccgtgagtccaagtcgctccctgtgaggggagcgtggattgaaattgatgcacctatccgatacaattcaccaaagaagtcgctccctgtgaggggagcgtggattgaaatttgcgcgcctacggtgtaagtctaggcgttatcagtcgctccctgtgaggggagcgtggattgaaatgcccgtcttggtctgcacatacacgcagtcacgatgtcgctccctgtgaggggagcgtggattgaaatgccccagtttgcatcaagtaccacccaggagctgtgtcgctccctgtgaggggagcgtggattgaaatacattgtcaatagcaagatcaagacgagtcacagtcgctccctgtgaggggagcgtggattgaaattgtcgaaagtgtttgtgaaatataagtttaatcggtcgctccctgtgaggggagcgtggattgaaattgaccatccggcatctgttaccttgttcttcacacgtcgctccctgtgaggggagcgtggattgaaatatggcaaacgtaagaaatcagatcaatgactactggtcgctccctgtgaggggagcgtggattgaaatgatctgcttgtgatgtgttgttaccgtcgcttgtggtcgctccctgtgaggggagcgtggattgaaattccctcttctgcgttttccgctgcgagaccgtatatgtcgctccctgtgaggggagcgtggattgaaatctcattgattgatgcttttaggtgtaatccaatgtcgctccctgtgaggggagcgtggattgaaatataatttaggttatgaatttatgtttgtaaaggatgtcgctccctgtgaggggagcgtggattgaaataaaatactccatgtcagatgccgacagcacggcgtgtcgctccctgtgaggggggcgtggattgaaatgcatttaaccgtccatagtttcccgcgtcataagtcgctccctgtgaggggagcgtggattgaaatccgtttccaagtttggggagctccgaagctgttgtcgctccctgtgaggggagcgtggattgaaatatatactcccatgccgtttctcatgtttgcaacagtcgctccctgtgaggggagcgtggattgaaatattttcttgtcgcatacaaggtcaatggcgttgtcgtcgctccctgtgaggggagcgtggattgaaatatctactgtgtagtgaatttccgttccgcaaggtgcgtcgctccctgtgaggggagcgtggattgaaatattttgaagatatagagtggttatgcggatatatgtcgctccctgtgaggggagcgtggattgaaatcgccatggcgaagcaatatcaagtggcgcagctatgtcgctccctgtgaggggagcgtggattgaaatatctgcaatttgacttgcgtatactatttccaagtcgctccctgtgaggggagcgtggattgaaattatgtatttaattatcattagcaccaccccttttgtcgctccctgtgaggggagcgtggattgaaatatatcttttacaaatttaacttcactatgatttgtcgctccctgtgaggggagcgtggattgaaattgaaggattttttaaaattcccgccacaaaaatcagtcgctccctgtgaggggagcgtggattgaaattttgaattgaaaaaatacactgcattgcagatcggtcgctccctgtgaggggagcgtggattgaaatgtcgacctgtacttcaaagtttccatcgcacgcgcgtcgctccctgtgaggggagcgtggattgaaatttgatcggatatacaccaaaaagaagcatctttgtgtcgcttcctgtgaggggagcgtggattgaaatatcacagatacaggcaaagcaccaagggaatagtgtgtcgctccctgtgaggggagcgtggattgaaatatcacagatacaggcaaagcaccaagggaatagtgtgtcgctccctgtgaggggagcgtggattgaaatcccttgctacaattataaaaacagcggagctacgtcgctccctgtgaggggagcgtggattgaaatcgcagtggctgccgggacaggagataactgtggcgtcgctccctgtgaggggagcgaggattgaaatacgaattacatgaaagagggcaagtcattatttgtcgctccctgtgaggggagcgaggattgaaattttgtagtgttcccggactccacggtcgcaactgtcgctccctgtgaggggagcgaggattgaaatcattggatatgtggagcagaacatggatttcacggtgtcgctccctgtgaggggagcgaggattgaaattttttaaagtgatatgatagtatcaacaagaaaagtcgctccctgtgaggggagtgtggattgaaattaatatcagtatgacccatttgcgtttttattagtcgctccctgtgaggggagcgtggattgaaattggaagaagcaaccacgatcaccgatattctgggtcgctccctgtgaggggagcgaggattgaaattttacaacgatctctcgttgtattgtttggttttgtcgctccctgtgaggggagcgaggattgaagtagtcagatggctgatgttgttgcccgttctggatcgctcgcagcgaggaaagtgtggattggaaggttgatctcagcttggagacaggcgtgagagtggagttattcccagagaggggagtgtgggttgaaatatcgctaataatatagaagggatagcatggctgtgtttcgtactctgcgaagaaaacacgtttgtatctaccacttctggccaaagtcgcaactattacatcttcgagatagcgaaagatactaaaaaactatccctcttcactacgtaataggggggatgaaataatagctttgatgtgacttggttttgctggtgcatttatcaacatcaagagttttgtgcatgagacagatatgtcgaagaagcaaaggtaaagtagttgaagttgtggacacacaataatgaaatatatattccatgcgaacgaaatcttctgtaaaatcccccgaaaatctgttgaaaattcctaaaaaatgttattattttgatgttttttcttgaaaaacgccacttacattttgtgagataaagcgttagaatagctatgctataagaatactttatacatatttaataatttattaacagaaagggagtatagatatggaatcgtattcatttttactgttcttggcgatcattatgatctcaaccaagattctgggtttatttacccgtaagattcatatgccggcggttgtcggtgcattagttgcaggtgtgatcttaggaccgtcctgtctgaacttgattacattgaccggagataccggcgtctttcttgagcagatggcagagctcggtgttatcctcctgatgtttaacgcaggactggagacggatctgtccgaacttaagaaaaatggtgtggcatctttcgtaacagcattgatcggtgtgattgttccgttgattggtggattcctggggtatgcatttttcttccacacagacttcagcgattacgatgaggtgttaaaggcagtgttcgtcggtgttgtactgacagcaacatctgtaagtatcacagttgagacgctgcgtgagatgggcaagctgaaaggaaaagtcggaacgacaatccttggcgcagctgttatcgatgatatcatcggtattatcgtactcacaatcgtaaccagcttaaaggataccagcgtaagcccgatcacagttgtgttaaagattgtactgtatttcgtatttattgcagtattgatcttcgtgcttacaaagttaaaggtatttgtggaagagcaggatgagaagagaagaaccgctatcatctgtgtagcgctctgcttcattctttcctatatctcagaggaatacttcggtattgcagatattaccggtgcttacttcgcaggactgatgctctgcacgatgaaagttggaccgtatgttgcaagaagatgcgagatcccgtcttacttgattttctcaccggtattctttgccagtgtaggtcttaaggtaacactcggcggaatggatgccagcatctggatcttcgcaatcattctgcttgttatcgccatcttaagcaaggttgtcggatgcggactgggtgcaaagatatgcggatgtaccggaaaggaagcgttccaggtcggtatcggtatgatttcccgaggtgaggttgcactgattgtggcgcagaagggatatgcaagcggtatgttagatgatgtcctgtttgctccgatcgttctcgttgttattgtaacgacgctgatcaccccgattctcttaaagcttgtcatgaaagacaatgattctgagaaagctgctgcataggggcatagaacagatattataaaatcaggatttaagaagccgtcacttttgtggcggtttcttttttcactctataggctatgtgagtttattgcttcttttgcaaaaaacagttaaaatagacacagaaaaaagaaatgaggagattgcaatgttacgggatctgcaggaaatatcagatggaaaaatatatggctgcaatgatatggttcgggcggcgtgcggagactgcgcgggatgtcatgcctgctgtgagaaaatggggacatccattgtgcttgatccctgtgatatatggcgtctgacgaccgtgaccgggaaaaattttgagcagctgctggtcgatacgatagagctgcaggtagtggacggcgtgattcttccgaacctgaggatggacggagaaaaagagcagtgtgtgttcttgaatgaacagggaagatgcaggatccacgcaatgcgtcccgggttgtgtcgtgtatttccgcttggcagaatctatgaggaaagcagaatccgctactttctgcagatggatgcctgtcagaagcccgggcgcagcaaagtgaaggttggaaaatggctcgatactccgcagatggaacgatacgaacggtttctgatggactggcatggcctgcggaagcagctggagaagcaggtgaaagacggaattggtgaacaggaggcaaagacgatcaacatgtttttgttaaatctgttttttataaaaccatatgaaccggagcaggacttctatgaacagtatgaggagagaagagcgatggccggtcaggcagggttaaaataaactgcggataatgtatggcaggagatggaagtatgataatcgacagaggattggatcagaaaggaacagatgcgaatattggaaccagccgcgtcaatctcacgcagcgttatgtggaatccgtcaaatacaatggtctgggggattttaccgaagaattgcgtgaggaagcagactaccggaagcgcattgaaaagattttctcggaaattcatatgactggggagacgtatgcggatctacagccagaggcattgatggaagcctactggcagggagaggaaatgatatcgcgttactactgggcaaagaggcgggacacggacgacattatctgggtgcgtgtggacgtgaggattgtaccgcagctggatacgggagatttgtttgccttttacaataactgggatgtcacgcatgagaaaaaccgtgaccgtatgatgcagctgatcattgagttcgactatgattatgtggaatacatctgtctgcagaatggtcatttcgagattatggcgcaggaaaaaagttccatgtgtccgagcgccagaggaacagactacgatgcggatatccgtgattatcttaccagagtcgcagtgacggatcagctggaagcacacatccgggcaatgcagacagaggaaatccgtcgtaaccttgaggcagagccactttacatacaggaaattgatgtgagagagtctgatggctcagtgcggcgtaaaatgatccgttatacctatatggataagcagatggggacggtattcaaaagctgtgtggacatcgaagacatcgtaacggaggagaagaagaagcaggaacgtctggagcgggcaattgaagaaacggagcgggcgaattgcgccaagagtgaattcctggcccatatgagtcatgacatccggacacctatgaatgcgattatcggcatgacatccgttgcaaggcaggaatgtcaggatgagacgatctgcggatatctggataaaatcaaatcctcaagtgagtttcttctcggactgatcaatgatatgctggatatttcacgtatagagagcggtaatctgaacctgaagtcggagcagatgagcagaaagacgtttggaacggcaatcaataccacgatcggcccgctgatggagcagaaaaacattacgttccagtgtgatctgcagcatatggaagaaatgatatacactgatgcggtgcggttcaagcagattttcttcaatctgctgtccaatgcagcaaaatacacgccagagggcggaaatgtgtggcttctgaccgaaaggctccgcacggaaggaaacgttgaatgggtgcgttttacggtgcgggatagtggaatcggtatgagtgaggaattcctggagcatgcgtttgaaccgttttcgcaggagggtaaccgcacgcttgccctgcaatggcagggaaccggtcttggacttgcgatcgtaaagaaactggtggtcatgatgcacggcacgattgaaattcacagtaaattaggagcgggtaccggggtaatcctcgatctgccgcttacgatctcgggcatcgatgctccggaaaaaatgccacaggcagtcatggcaaaacagaacctggaaggcagacgggtgcttctggcagaggacaatgagatcaatacttttgtggccagacgtattctggaatcaaggggaattattgtggaacatgcggaaaatggaaaaagagcggtggaaatggtggagcagaatccggagggatattttgacgcaatcgtgatggatatccggatgccggtgatgagcggactggaggcagccagacagatccgggcaatgagccggacggatgcacagactgtgcccataattgctatgacggccaatgcctatgaggaagatgtcagccagtcgttggcggccgggatgaacgctcatcttgcaaagccgatcgaaccgcaggtgattctggatacacttgcggggtatataggcagtaagaactagaaagttgcactgtaaatagaaaaagaaaggcatgcatttcgtcggaatgtcgatgtaaaagttgtgatactgttgctataataagttccgatgagaggagacggcaggatgaagcatttgaaacaatttttgattattttacttttttcatttcttggagaaggattaaaggcattgcttccacttccggtaccggcaagcatctatggactggtattgttgtttgcggcactggagcttggaataataaaactctctgcagtggaagatgcagggaaatttttgatagagatcatgccggtgatgtttattccggcgggggcggggctggtcgagtcctggagcgctttaaagccgatctgtgtgcaggtggttgtgatcatgtttgtatccacgattgtggttatggtgatttcgggaagagtgacacagtttgtaattcgcagaaacagaaaggcataaaacaatgaaggaatttttaaatcagtctgtatttttcggtgtggcaatcagcgtattgacctatgaactgggagtatttttgaaaaagaagctgaagtggccgatatgtaatccacttttaatttcgatcgtcgcggtgatcgtttttctggtcgcgtttgatattccttacgagagttataacgcgggagcaaaatatctgagctatcttctgacgccggcaacggtctgtctggcgatcccgctctacgagcaggtggagcttttgaaaaaacattccaaggcaatcgtgcttggattgatctccggtgtgattacgagtcttgtgtgtgtgcttgtactggcactgttgtttcattttgatcatgcgcagtatgtgacgcttctgccgaaatccatcacgaccgcgatcggcatgggaatatcggaggagcttggcggttatgtgaccatcacggttgctgtgattattattaccggagtgattggcaatatgctggcggagacggtctgccgtatatttaagattgaggagccggtggcaaagggaattgcaatcggagcgtcatcccatgcggttggtacagtcaaggcgatggagataggagagatcgaaggtgcgatgagcagtcttgccattgcggttgcgggacttctgacagttgtgctggcaccggtatttgcaggaattatgtagcacgcggtctgcctgccctatatgcagatcattatgcaccaggatcttatatctgacataagataaagagagaaaacaaagaagtggaatctttatgtattgtcagaatagaatggtacacaccgtgcaggagggggattcactgtatcgccttgcgagacagtaccacacaaccgtcacggaactgatactcggaaatccgggggtaaacccctacaacctgcaggtaggaatgaagctctatgtctgcccgggggaaagctacgtaccgccccagggaggcagcgcaaacaccgggaacacgggaaacagcggaagcaccgggaacaccggtaatgctggaaatggtggaaataccagtaatgccggcgtgggcggaaacatcggtatcggagtggtgattccgggtggacagcgcccgggcggaaatcagacagcgggagagaggcagaattcagtgaatcagctgtttgagacaatgcgtctggcgtggctggaactgatctactggacacggatgtatatgatgagtgtggattccggggcagatgcaaaagagcagtatgcagtggagggacgcctgttggaaactgcagatgcaatcacggatgtttttgcagagcggctgccggtagctgtcacaagacagctgcgcaatctgctcgtggaacatgtggagatgacggggcagatcatccgcacgttaaaatccggggataaggagaattatgaacagcagatccgggagtggtatgctaatgcgaatcagatcgcaacacttctcgctgaccagaatccctactttgcaggaaaagagacgaggaatcttctgttgaattatctggatatgacgcgcgagattatagaacatcagatgaacggtgagtatgaccagagcattgataccttccgggatttaagtgatctggtgctggaactcgctgattatctcgcaagaggacttctggcgcgctgatgtgctttgcaaacgggcggtgcctcttgtgcatcgcctttctggtactatttgcggcgctgctgatcctggcagtagtgcacagagtgcgggcgaagaaaaaagttcttgcattgactcccggggaacgggtgcggctgctcaatgaactggcggaaccctttggatttgcttatctgccgtcggaagatatttttacctcaaggctggatgcctggcagcgtgacaagggatatgaggcgaaatatgataccatgacggtgggtgccgggatggtgattgacgcatttcccgtgtactttaattatgagggaagaacctggctggtggaattctggaagggacagtacgggatcaacaccggcggagaggtcggaatttaccatgcgaagggcgtgattccgccgcacgcctatcacacggcgcattttgaagcggtatcggatgcagaactcccgagaatctgcagctgtctggatacggcagaggaaacgttttatgaaatctgtgccagacactggtggctcaccggctttcggatgggcgtgtatacaaaaccgtcgcgcctcagacttgccacgacgctgattttcccagagcaggagatggcgctggcgttctgggaaggtctccacaaaaccggaaaaccgcgcagcctttttcgcatctgcggaagagaagtcagtgtgcggatgaatttttcggaggaacacggattgattccgggaatctgcagaagcgtggtgcttctctggaacaggctgctgtgcagaggatttaggatcgtgacatacccgtggaaacggacggcggacagaatggtatttctatattatctgcttccgggatggtttcggaagattctggtgctttcgggcgggcgatgcaaaccgcgctgcaggaccaggaaaccgcacagatcatgtcggggcaggtgaaaacatgggatgttatcgaaggattgacagggcattggaacatgccctgcaccttccgcttggcacgggcagccgctatgtggtgatcagtgactgccacagaggggaagggacaacaaatgacaatttcctgaaaaacgcgtacctgtacgaggcggcgatggaacattatataaagagaggattcttctatctggaactgggggacggggaggaactctgggaaaaccgctgcatggaccggattgtgcactatcacgagaccgtgtatgagatgtttgcttgtctgcaaagccggaatgcgctgtgccgcatctatggaaaccacaatatggagctgagaaaaatcctgccggaggcgattatattagataattgcgagggcggaagggatgtctgcatgattcacgggcatcaggcggatttttttaattctgtgtgctggaggctctccagagctctggtgcgctacgtgtggaaaccgttggagcgctccggcgtgaatgatcccacgagtgcggcgcgcaattataaaaaggcggtccggtatgaacagtgcctggcgggctggaccagacttcacgaccgttatctgattgccggccattcacacagaccgagactgccggaaaacggggagctgtatctgaatgcgggaagctgtgtgcatcccgggtgcatcactgccatcgaactggaacagatgcagatgacgcttgtgaaatggaaggtggcgacgcgcccggacatgaccatgtatgtggtacgtgagaagcttgccggaccggttgccattttgtaggaaaaacgcgatttttcaaaaaaatcatttgacggaaccgccatttatgataatatatatatcgttatattaaatcgttaaagcgaggacggaagcgtccctgacgatagctggtaattggaggagcagaaaaatgattaaagttgtgaagtttggcggcagctctctggcaagtgcggaacagtttgcaaaagtggggaagatcattcaggcggataaggaaagacgttatgtagtgccgagtgccccgggaaaacgcaatgccaaggacaccaaggtcacagatatgttatatgcctgttatgcgctggtggaggcggaggaggatttccgcgtgccgctgatgaagatcaaggaccgctatgacacaattatcaatggactgaatctgaagctgtcactggaggaagaattcaaaaagatcagtgagaactttaaaaataaagcgggggttgactatgcggcgtcccgcggcgaatatctgaacggtattattatggcgaattaccttggctacgagtttgtggatgcggcagaggtgatttccttcgaggaggacggaacttttgacgcggagaagaccaacaaggtgctggcagagcgtctggagaaatgcgagcgtgcggtaattccgggattctacggggcactgccggacggaacgatcaagaccttttccagaggcggttccgacatcacgggatccatcgtggcgcgtgcggtacatgccacctgctatgagaactggacggatgtgtcgggctttctcattgcagatccgcgcatcattaaggatccgcagccgatcaagacgatcacataccgtgagctgcgcgagctttcctatatgggcgccagcgtgcttcatgaggacgcagtgttcccggtgagaaaagcaggaattccgatcaacatccgcaataccaacgcgccggatgacgagggaacctggatcgtggagagcacctgccatcagtcaaaatacaccattaccggtattgccggcaaaaaaggttttgtttccgtcaatattgataaggatatgatgaattccgaggttggattcgggagaaaagtattgtccgcgtttgaggagaataatatctcattcgagcatatgccgtctggcatcgacacgatgacaatcttcgttcaccagccggaattcgagggcaaggagcaggcagtgatctcagcaattcaccgtctggcaaagccggacagtatcgagctggagggtgatctggcgctgatcgcggttgtgggacgcggcatgaagtcgaccagaggaacggcaggccgtatcttctcggcactggcacatgcaaacatcaacgtcaagatgatcgatcagggatcttctgagcttaacattattatcggtgtgagcaatgcggattttgaaccggcaatccgtgcgatctatgacattttcgtggagacccagctttaagattaagatatgaagaacaacaagcacgagcaaaatgaattacagcgtatgatggaaggcagggctgcccgcatgattgcggctgcagtcactgtctttttgtgcgtactgacattgtttgaatttgttgcgctcaagatggagtggaatgtgcctgcactggcggtgctaagcggcgacaacggactgtggaccagggagtaccagcgggaagaactggtgatggacggcagcacggaaaacattctgctcgcagacgatggagagacaccgctcacaggaagtggtgagaatgccaaaacgaatgtgggggaaaacggaagcggcgggacggcgcagaccggtgaaaatgcagggaacggggaagacttgcaggtggaagggacagaagcggtgcggcaggaagagactgagacgccggatgtaagcggaaccggaaaagcggaagcggatgttaaggagacgcagacaccggaattttcgtattatatccgcatcaatcgcaagcagaactgcgtcacgatctacacccaggatgaggagggggagtatacggtaccctataaggcaatggtatgctcgaccggactttacaacgcaacgccgcgcggaacttaccagatttccaccaagtatctgtggcgggaactctatggcggtgtgtatgggcagtacgcgacgcggattcacgggggaatcctgttccattctgtgccctattacaagcgcgcaaaggatacactctgtacggacaagtataacaagctgggacagcaggcgtcgatgggctgcgtaagactgacggtggaggatgcaaaatggattgcggagaactgcccggaaggcactacggttgaaatatacgacggggaagacccggggccgctcgggaaaccggaggcacaaaaactggataaatcagatccggactgccactgggatccgactgatccggatgaggaaaatccctggcagcagacggagacgtccgtgacggagagcgagcaggaaaaacagataaaatagaaaaaataaaacgacgaaggcgacatcctattcatttgaatcgatgtcgccttctaaactatctcgtccatgggactgtacctctcttttctttttctttcggacttcttcgcttccttcgtaccttgtatcactcttcttatgacggtggatatcgcatcatatctgattaactcatctgatactgattcctctttccatgatttggattgtcacgtgtgtttttcgggagttagaaaaaaacgaatgcaattacgttttcggtggtctgtacctctctttccttaatatcgttttgggtaaatcgttacgtttctggtggcttgtaccttcctttccttcgatttcgttttcctttctttttgttgtctttattctatctgatatatgagaaaaagtcaagcataaaatgagaaaattataataaaaaatatttaaaaacaataaacaaagaataaacgaaaaaatattctgaaaatatagatgcaatagatataatatatatttttcgtaaaatacatgtaaatgcttcgctgtggcagaagagcgtgcgcttcatataataaagagaagggagcgtaattctatgaatagacagaccatacttctcatcagtgacatgcgccaggtttatctggcggagattatgaccaaaagaggactcaacgtacgctgcctggatatcagaaacagcgggacggtaaaagaacaaatcgagaagttgaaaagttttctggcggaggcggatatgctgatcctcccgattccggtgacaaagataccggaacagaaaatgctgaacgatatattgaataaaaacctgacgaacgatacgctggtgcttggaggctgcttctccacagaacagcaggagcttttggagcgccgggacattcactatctggattttatgaaagatgagattgtgacggaagaaaatgcagtggcgacggcggagggcgtgatcgcggagcttgtgaaccacagcccttataacattgaggaggcaaaaattatcgtcaccggttacggctgctgcggcagagcggtggctgcgaggctgaaagcgctcggcgcgcgcgtgacggtgctggcaagaagacgggaagtgcgcaaacttgccaagaaggatggattttatgccgcggattttgcgtttggaccggaggaagcgatgggggcggcaatgctggtcaacacggttcctgcgcctgtggttacaggtgcgatcatccgcgaactgccgcgggatgcatatattttagacatcgcgtccaaaccgggcggtacggattttgcctgcgccagagagtgcggcatccgtgcggatctggcacttggacttccgggaaaatatgcgccgaaggagagcgcctatattctggaccgggcggtggagagattcgtgcgaaaggagcatgaaatgtgatggatttttccaattataatatcgggcttggaattaccggttcgttttgtacgtttgcgaaagcaagaaaagaaatacagcggctgtgcgatatgggcgccaatgtggtgccggttttttcatttaatgcgcagacgtgtgacacgcggttcggaagtgcgaaagattatgtggacggaatctgcgagattaccggaaatgagggcatccgtaccatctgtgcggcggagccgatcggaccgaataattttctggacatcatggtcattgcgccctgcaccggaaatacggcggcaaaactctgcaacggaatcacggatacgccggtgctgatggcgaccaaagcgcatatgcgcaacggtaagccgcttgtgattgccatctcgacgaacgatgcgctcggcgccagctttaagaatatcggaatgctgatgaatatgaaaaatatttatttcgttccgttcgggcaggacaactgcaagagcaagccgaactccatgattgcaaaaatggagctcctgccggacacaatcgaggcggcgctcgccggcaaacagatccagccgattctgcagaccccgacgtaacgcagatctgacggagccgggcggagacagagacggaaaatgccggggacgttttattatgcaaaaaatcagagcatcttatgttccggccgcttctggcaggggcggattttgcgattagaaatgccgcctccgttacagccggaacattgagcgctcggtttctactcctgcaacttagtccacaaaaatcaatacgcctgtcccgggacaggcgcgttttgcgtttacaggtgtttccttacgcctgcttggatgcctcgtaggcttcgcgacaggccttagccagctgatcgccgcaggaagtcgggcgtccgttgcaggagatgccgccgattttctcctcaacctgctcgacggtaagaccctcgacgagcttcggaatcgcttgaagattgccgttgcagccgccggtgaactttacgttatgcacgatgttgccctctaattcaagatcaatctgtgtggagcaggtgcccttggtcttatatgtgtatgtcattttgaaatcctcctttattgaaaaaatagatcgttcagatcacttttgagtataacatggaaccggaagtgtgcaagaaaaatttgcagtaaagcggcagttaataaaaaatttacaattcttttacgcctgtttttattgtggtggtgctggaaaagtgttacaataacaatattgtgcggggtcatacccttttgcaggtgtcccgcaggagaatggattttgacacagttttgtgtaaaaacaggagtaggagctttttatgagtgcaataacgaagatcttcggaacccacagcgagcgtgagttaaagcggatttacccgcttgtcgacaaggtggaatcttaccgcgaggcgatgggagcactttccgatgaagaattaaagaacaagacgaaggaatataaggagagactggagaacggcgagacgctggatgatcttcttccggaggcatatgcgacggtgcgcgaggcggcgaagcgtgtgctcggcatggagcattaccgcgtgcagattatcggtggtatcattctccaccagggacgtatcgcagagatgaagaccggtgaaggtaagactctggtatcgacactgccggcatacttaaatgcgcttgagggcaagggcgtgtgcatcgtcacagtcaatgactatctggcaaagcgtgactctgagtggatgggacaggtccatgaattcctgggactgaaagtcggcgtggttttgaacgagatgacgaacgatgagcgccgggatgcctataactgtgacattacctacgtgacaaacaatgagcttggttttgattatctgcgtgacaacatggtaatctataaggagcagctggtgcagcgcggactgcattttgccatcatcgacgaggtcgactcggtattgatcgatgaggcgcgtacaccgctcatcatttccggacagagcggcaaatccaccagactgtatgaagcatgcgatattctggcgtgccagatgaagcgcggtgaggacatgccggagtattccaagatggatgccatcatgggcgtggagcaggaggagaccggagacttcatcgtaaacgagaaggataaggtggtcagcctgacacaggatggtgtgaagaaggttgagcagttcttcaagatagagaacctggctgatccggagaatctggagattcagcataacattattctggcgctgcgcgcacacaacctgatgttccgcgaccaggattacgtggtgaaggacgaccaggttatgatcgtcgatgagtttaccggacgtatcatgccgggacgccgttattcagacggacttcatcaggcgattgaggcgaaggagcatgtgaaggtcaagagagagagcaagactctggcaacgatcacattccagaacttctttaacaagtttgagaagaaagcaggtatgaccggtaccgcattgacggaggagaaggagttccgcgacatctacggcatggacgtcgtcgagatcccgaccaaccgcccgatcgcccgtatcgatcatcatgatgttgtatacaagacaaagaatgaaaaatacaaggcggttgtggaggaagtggtaaaatcccatgaaaagggacagccggtacttgtcggtaccatcaatatcgatacttccgagctgatcagcggcatgctgaagcgcgagggaattccgcatacggtattgaacgcaaagttccatgaaaaagaggctgagattgtagccggtgccggacagcatggagcggtgacgatcgcgaccaacatggcaggacgtggtaccgatattaagctggatgatgagtcgaaggctgcaggcggtttgaagatcatcggtacagagcgtcatgaatccagacgtattgataaccagctgcgcggtcgttccggacgtcagggagatccgggtgagtcccagttcttcatttctcttgaagacgatctgatgcgtctgttcggttctgagaagctgatggacattttcaatgcactcggtgttccggaaggtgagcagatccagcataagatgctgacatctgcgattgagaaagcgcagaagaagatcgagggcaacaacttcggtatcagaaagaatcttcttgagtatgatcaggttatgaacgatcagagagagattatctacaaggagcgccgccgcgtactggacggagagaacatgcgcgatgcgattttcaagatgatcacggatcgtgtggaaaattgtgtagatacctgtatttcttctgatattccgaaggaagagtgggatctgaatgaactgaaccagctgatcctctccatgattccgatgcaggcagtgacgccggaggacgtggacagcgttaagaataataaggaactgaagcatctgttaaaggagcgtgcagtgaagctgtatgaggcgaaggagacggagttccctgagccggagcagttccgtgaacttgaacgtgtcgttctcctgaaggtgatcgaccgcaagtggatggatcacattgatgatatggatcagcttcgtcagggtatcggactgcagtcctacggacagagagatccgcttgtcgagtacaagatggcaggatttgacatgttcgacgagatgacggcgagcattcaggaggatacgatccggctactgtatcatgtgaagattgagcagaaggttgagcgtgagcaggtagcgaaagtgaccggaacgaacaaggatgagtctgcgacgaacacgccgaagaagcgtgctgcggcaaaggtatatccgaacgatccgtgtccgtgtggaagcggcaagaagtataagcagtgctgcggcagaaacgcagcgcagtaggagtgctgcaaacggcagactgcaatgacgggcggacggcagaacgctgtttatccggcagaaaagtcgacagaacagcataaggaagagagagcatttcaggtagataattattgccgggaatgctctttttgcatattttcatctgtatgcagaaaaatacatacagagtgcatttttgggtggcaatttccagaaatctgatttataattcataccaaacaggtagaatatgagacggcagactgccggacagaaggaggaacactatgtacaacgtaagaaaagtgactgaggatattgtttgggttggagccagtgacagaagactggcgctgtttgaaaatatatttccaattccgcgcggggtatcctacaactcttatgtattattggatgagaagacggtacttttggatacagtcgatgcgtccgtggcgggacagttttttgaaaatctggagcatgtgctcgacggacggaaactggattatctgattgtcaatcacatggaaccggatcactgtgcgatgatcggggatctggtgcgccgttacccggaagtgcaggtggtcggaaacaccaagacatttggaatgataaaacagttcttcggaacggatttcgcggagagagccgtgacggtaaaagagggagatacgcttgcaaccggtgcgcatacattgcactttgtgatggcgccgatggtacactggccggaggtaatggtaacctatgatgagaaggacaaggtgctttttgctgcggacggattcggaacgtttggcgcattgaacggcaatatttttgcggatgaagtcgattttgaccgcgactggctggatgatgccagaagatattacacgaatatcgtcggaaagtatggtgcatcggtgcaggcattgttaaagaaagcctccgggctggagatcgcagtgatctgcccgctccacggacccatctggcgggagaatctgggctatattctggaaaaatatcagaagtggagcacctatgaggcggaggatcaggcggttgtgattctgtatgcaacgatgtacggtaacacggcatcggcggcggatgcgcttgcaggaagacttgcggcaaagggcgtgaagaagattgccgtttatgatgtctcgaacacccatgtgtcggagctcatcagtgagatcttccgcgcaagccatgtggtgtttgcagcgccgacttacaacggaggcatctatccggtgatggagaacctgctcgccgacatgaaggcacttgcggttcagaacaagaccgtagcactgatggagaacggcacctgggcaccgacgacggcaaagcagatgagagaaaaactggcggaactgaaaaatgtgacgattctggatacgcagatcaccataaaatcggcgatggcaccggagcaggaaggacagcttgaggcacttgcggatgcgatcgtagcgagcatggataagcagtaattgtgttactgactttatcattgcgttttgtgggaagcaaagactttctcatataaataacggataacaaaagaagaaatagcgcgatcgtttcaggatcgctggttgggaaaaggcacctgtttgcgtgtacaaagtaatatgtacgaagtggatgggtgtctttttctgctttataagaaaatgcattctgtggagagaactctttttataacaaaagcgaacatttgtttgcaattgaaaaaagatgtgatataatgtgcatatgcaatgagcagtgccagacgtgacggctgcgatatatgtctgcttgcaggctatatatcgcagatgttgcggatgatagggcgaatgcccgtcagtccggaaaatctatgatttttcggacgagcactgcgggtatgaacagagacggttgcgcatgcttgcatgcggcagacggatatgcgccatgtgaacgcgcctcgcccggacttttgccggagcgtaatatgaacgtgatatttttgaggggcttatcactgggatagaggaactttgaaatgtggacaatacaacgaatggacgaaatggatgatggagatgaggaacgcttgccgggcgagccgatgatgacagcggttacgttggaaagtgatctgggagaaatacttcaatttcaaatgcctcacaactggttgcttatgcagggattacaagaaggagaagagtggcctgaggacatcgaggaggaggattcagaagcgttaaaagcgcgggaacaggcagcgtggatggaaaattattatcatgcgttgcaggaacttgagggggaagaagagcaatgtaagcatggggcagagggataaatcggaatttgtggagagatttcttgaactttccttattttacgggctttccagccccttaaatagtgaaatgatatgtattttcccttatttttgaccttatgcggaatcagcaagggaaataagggaattttttatttagtcgttgcctgccactttatcaagaagtctggcggagttccgctttgcctttcttgtagagtgggcgtagacattcattgtggtactgacatcagagtgccctaacagttcctgcacatcttttggggcagctccgtttgagaggaggttgcttgtgtaggtgtgtcgcaactggtggaaatggaaattctcaaatccgtccagcctttttgcaactgatcggcaggcaatgctgagtgtgcttggcagttccagacatccgtccggtctcaggcagacaaaggagatttccttgtaatctaccgggatttcttcggttccgtccagatgataatattcataatacactctgtttttgtcctgtgcttccttgtagaaattgcggtggtaaagttcaccatactgcatccggcttttaagctgtttttttctggcggttttcagtatttcagtcagagtatcgccaaaatcaacaatccttactttctttcgcttggtcggtccgatgatgtttttatgttttgtgccatcatagcggatacttcttttaatggtcaggcattgttcttcaagattgatgtcctgccatgtcaatccgcaaacttcaccgatacgaagtcccgcatagtatgcgatctggattggcaggattgcaggtggattctttactttgaggtattctatcagtctctcataatcttcatgggaaataggctgtatgccttcttctacctcatcatctgagaataaatccacatcctctgcctgttttttcagcttaatatactgcataggattaaaagtaatcaactgttttggaaatactgcaaaccggaaagcctgttgtaatactgctgaaaaggaatggatgtaatctttactgtatccttttctcacttttccatctggaaattccccaccgaatgtaagcagatcgagaaatgcctgtaaatgttcagcagtaacggtttttaatttgcgttctgcaatcggatgtttcttgatacaacggattgcaccaagataattttccactgtaccattgctgagtgttccgactttcagttcttcttccgcccacatatcaagaagttctcctacagtaagattatctgtctttgcgacaaatttcttgctttcgtaatcatccattgcctgacggagcagtttttccgtttcacttttactttctgttccagcgtattctttctgaaccagattgccgcttgcatcttctacatagaagcggtagtaccatttctttcctttttttcttacagatccttttgccataatcgtgtgtctcctttcgatatcagacaatcggaactgatgaaatgcttcttgcgtgtaagtatatcataactccggttgtcgttctataccgaatcggaatcctcatacaaaacttctgataaaagattttcaagcctttgttctgccatttccggtttcttggaataaagccttacgatatctgccatgtcgttaaaggcattaacagtgtgggtgatctcccggagaaacataatctcgttatattcatcattcgattcaaaccccattacttttgcaatatcagcttcattcgtgttgcccttgtaattcttgcaggcaaactggaatgattccagaaacaggttatattgctttaacatcaacagcagtaaatctttggaaaaagcatcttcctttttactaaggtcgagaggtaactgtttgagaatatcgcccattgcatcacgaatctgtaattctttcttatccgtaatatcggtttcgtattcatcggtttcccctctgagccattcaatagatacatgaagtgcttccgaaagaccttccagcaccatctttttggtattgtcaatcgaaccattctcataacgcaggattgtggaagcggtaactcccatcttctctgcaacataaggctgtgtcagatttaattccagacgacgctgttttgccctgctgcctatcagcttgcgtagttctttatctttcatgctgattgcctcctttttcggtatgtatgaattatagcatgtacctcacataattgcaatatgcaatataataattatttttaaaatttcataacgcttgacaacacaatataaaaccgctatactaacagcacaacaaaaattgcataatgcaattcataaggaggtgacaagatgacggaaagaaagattgcattatccatcgaggaagcagccgactatacaggaattggcagaaacactttgagaaagctggttgaatggaagaaacttccggtattaaaagtcggaagaaaagtccttattaaaactgacattctggaaaagttcatggaagccaacgaggggcgagatctgagggataaaggaaatgtaaaaactgtcacaagaaatgtggcaacttaaaaaggcggcttcctacgaaaccgccaaaggttctatcagaccgaagccatgatatacctacacgcaagaggattataccatgtgcttctcctgatatgcaaccgggaactaatgtttatcttgtcggaaaaacatcgacaagataatgctccgcaaggatgcaccacgattctgattggaattatgtcaacagagctgaccagaatcgtgtgccaaatcttagcagagcaagatttgattataagagaaaggatgaagacgatatggcgaaatcaacaaagacttatgaagaaagaatacgtgcattagagaaaaaggaacaggaaagcatcgaagctaccaaaaagctcattgcacagcgaaaggaactggaaaagagaaagaaagccgaggaaagtaaaaaacgaacccacaggctctgtcagattggcggtgcggtggaatcggttcttggctgtccgattgaggaggaagatttaccaaagttgataggcttcttaaaaaggcaggaaacaaacggaaagtttttctcaaaggcgatgcagaaagagccacttacagatatggaggaagtgtaatggcggagggagtggtttttccattcccttcattgcctttgaatgaagggcgcacttatggacaaccagaggtcgtccttataagtttgccacaagtggcaaccggtctgcgcttacgcttgccgggctcgttccgtcggcggggctttcagccagacctgctcatgccgcagggggcactcttgcgcagagggcgttccgacagcttcacttctgccaaaccagaagaagatgctgtcggaaatcaatgccggatacggcagaaagggggaatcgtatcatggcgatatttcactttacagtaaagattgtcgggcgcagtaaaggaaaatctgtcatatccgcatcggcatatcttaatggagatgtgatgaagaatgaggaaacaggcagaatcagttactatacttccaaaaaggaagtcgtctacaccagtctgatgatgtgcgaaaatgcacctcctgaatggctgcatgtaccggaagaaaatataaaaaggtttcaacagtctatccgttataaaagagcggatgataaagatgccgcactggaaaagtttaaaatcacatttcagaaacagcgtctatggaatgaggtattgaagatagaaaaaaatgcagatgcacagcttggacgctcatttgaattttccctgccgaaagaatggagcagacaggaacagattgattatacaaccgaatatattcaaaagactttcgtggacgagggaatgtgtgccgactggagcatacacgataagggcgacgggaacccacatgtgcatttacttgtaaccatgcgaccattcaatccagaccactcatggggcagcaaggaagtcaaggactgggattttgtcagagatactgacggaaatatcgtggttgatgaatcccacccggactggtggcaggataagaaaaatccagaccgtcatggaatccgtattccggtacttgatgaaaacggagtacagaaagtcggggcaagaaacagaaaacaatggaaaagggttctgactgacgctaccggctggaacaatccaaagaattgtgagttatggcgaagcgaatgggcaaagatgtgtaaccggcatttatccatagacaatctgattgaccaccgctcttatgaaagacagggcaaattgaaagtccctacgattcatgagggtgcagatgcaaggaagattgaggaaaaatatctcaccgggcagataaggaaaggttcatggaaggtcgaggaaaaccagatgataaaaaaacaaaatgcactgctgcaaaaggtaattgcaacctttggtaaggtatccggtgcattgtcgatgtggagggagtggttgaatgacattagaagaaagcaaagaagtaattcccatgatggaagcaatgattacacagatagaggaacagtagaatatcatggcagagatgcttcaggagatacaggaaaaggacgagaagctgatgtgctttcaggagcaggaagaacgattgcagcaattagagaaagaattgtcagagctgctacaaatcttaccggatacagaagaactgttgatgcttctggaagaaaagacagaccagatacagaaactcacagacgaaaatcagcaatggcaggaattggcacagaaattaaacagcgagaaccggctattgcagaaacagaacagcgaattactgaacttgaacagcaattagagaaaggaaggttgattgatgaacgaattaagaaactcaaagagcgacgatcaactggaagagttgcttctgctgacagagcagatgcaggaagaactcgaccagaaagaccggactatcagggaactgaaagtgcagctcgacgaatcgctgaccttgaacgagaagttaaacagcgagaacaaaacagagaacattcaagccttaaagaacgacttgaggaaaacaaaagaattgttgcagagcgagaaagagaaaacacacaccgtccaagccatgatagaggaatgtcgagataagcagagacaggcagaacaggaacgggattatgcactctcccatcagaaaaaagtagagataccggttgaaaagccggtactctatcaaaagtgcgggaattgtaaacagacagcttatctgaaagctaaggaaaagtatgatatgcagagggaaaaactggcaggcagatataaaacaaaaacagccatgtatgaagcattgatgtttctgctgatatggtattccgtatcaactactctttttcagatgatacggtcaaaaatatttatttctgattgcgtggtattctttgatacaatcgcaactttcacacagaccattgctggctgggttgtactggcaggaaagaacgtggcacagattagtgatggaatatccaatcctgtcgttgctggaattataaactggctgataagaatattgatttgcggtggatgtctggtgggtgtgggaatacttttggcattcatcgaaataaagattgcagggctatataagaaatactgttgggatatgattaccataatggtgatacttgtaagtatggcaatagctatctactttggggattggataaaggaagtattgccaatcaatctgctatttctcttattattcgtgcaactggtatatgttggaatcaggtggtatgtaaagggatggcgggaaaacagaggttatgtttaaaaataaaaaaattgtctgagacgcagcgaagtaaataaaatgagtagtattataagaagtcagcagtgcgtgaataaactgctggcttcttttttgatagatacagtcactctcagagagtgtgcaggatagtaaagtaataatatcaacatgccgatatagaaaatgcagggaagcattgtatttcaaagagtttgagatacagagcttctactaaggcagtggtcatcttgtaaaaatatggtctttgtgtgcgtaatatggtcgtttgatgatatgggactaggagaacaggttattttatccgataaagaaagcaaaggaggttactatgagtaatacaattaatgtgaactatatgacacgggcttacaatcagtaccagcagaaaaatgcggctaaagatcaggagaaggaagatacaaggtttgcggatagtgtaagagaaaagagcgaagctagtggaagtatagtgggcaattcaaaaataggttctgtgtctgctaaagatatgacgatggtggaatacaagcagtacatttacaattcagataaaatgattggaggaacagaagtatgcacattggttctggtctaaatacggtatcttcaatgtaccgccaacaaaaaggcaataatatgaaaacgcctgcatctggggaaaagacattttatacggcagaaacaccgaaggtatatcagatattcacaacagataatatgttgtggacaggaggtaatggcaccggtctttcttattgtcttaaatatgcggatgattcaacggatgaaaatccggtggtgttagcgaaaggtgtggatgaaaatggaaaagagtttgaacaaagaatatatatcaatgacgttaatccatcaagtgctacagtagtcgaaatgcgtgcattggaggcacattacaaagtggagaagcagggaggtttcacatctttgccgcttgaagctggtaatatgggacttaacgacagaagagattttatctcaatgttcaaaaaaagcatagaagatttaaacaaattgggaaggtttgacttatcgttgctttggacgaaaagtatggatacatatcttaatttgccaaatgcaaatagtaagtataaatagtgcttagtcatttgaacatagggaaaaaagagaacttggattacatatcatattgaggctgagagaaattaaatatccaagtcgttcaatataatagaaattattttaagtttcaataacagggaggtaggattatggcaattacgggtatcaataacagcagttacacatcgtattatgcttcaaattataagaatactgtaaaaaaaacagatagtgaaaaggatagtacaaatacaaaagacggcaacgtgacaacaagtacagttgaattaaaaacatcacgtcccggtgtgacaaaaacagagcagattaagacggggtatagcaatgtaaatgattattcaaaatacttgcaaggaaaataccattatatgaatacgggaacgacttcaatgcaaggggttccgacaacagtatccgtttcaagtgcatttttacagaagtgtatgaatgatccagaaaaagcaaagtatctggaggaaaacttagcagccattccagattgtgcaaaaagtgcggtgaatggatgtttgggcactttgacaaatctgagttatatgattgatgcaaacggaaatatttcggtggcaatatctggtacaaatgatccagatgggaaaatagcgaaagagaatgctgaacgaaaagcaaaagagaacagagaaaaagaggaaaaagtaaaagagaaaagagctgctaaaaaagcagaggaagaaaaagctgcaaagcaacgtgcagaaaaatcggcagaaagaaaagaaacgggtgattataccttatccataactggtaatgatgtaaaaagtatgacacagagccttgtagcagaatctgtgagtatttctgcacctgatagatcaagttttgatattaaggcataagaggattcgataaaaggaaaatatcaaattggtgcattggatggcatcaccagagagtagagtggcagaaagtcagtagatataaatcgttttattggttcattgagcaatgacagtgatgtagattacctgaaaatagatgcaggttctttgacatcgagcaagatagataaagaagtatagaaagtgtggactaacttaaggaggttgctatgaaagttcaaggaaataggtatattaataatccagagatgataaaaaataaggttgagaagaaaacaactgttcctcagaatattatttcggaggatgatgtgaaaatcagtgattcagcaagaaagttagttgagactgctcgtaataaggtatcggattttcatacaatgcatttttcgtcaatcaatggagagataaaagaaataccagcagaatataaatgtgaaaatttattcaaattagatttgaaagcaacttccatttctggagaacaaaatgcgtttgaaggctgttcggaaaatcaatcagaggtttttgaaaaatggctggacgaaaatgcttctgaatatttgacagaagatgaaatgaaagatttaaaagagaagattaatgcaatgacagcagatgtagattctttgaatgctcaggagggatatagaggaacttcctatgaatctgtatttttgttaagtgcaagtgaagcggggctaagaaaagtaaatgaaatgtatgttccagatcaattacaagcaggtttttcagacatgattgacgaatatgttcattttaatgattcggcacgtaattctatcatggagaaaatgacaccagattacatggttgttggaattggaagcaaaacagaatcttataagtacaagtcagaaataatctcagatgagacagctttttatacaaatgagaagaaagagataagtggtatctgcaatcagtttttaaatggtaaaacagatcaaaaattattttgtaatgagatgaaagaccgtttaaatgattactatggaagcaggtatgaattaaggaatcagccagaagctgttgaaggcagagtaaataatatgctggacaaattgcagcatatgtttggcgtttaatgttgaaaaagggtttggagaataattatgaagacagtgacagatgtaaacacagtaaaccagctattgacatattcaaagcaggcaggggcaggaatacaccaaaaagcaatacagatgttgcttggagcaggaaataataaaaaacaggacagtttaagtatttctgatgctgcacgaggcttttcaaagcaatccatagctgcactgatagataaaaatgcgaatatttctaacagtgaattagcttattattttgcaaactataataattcaagtgctattttggatgcaatcaattttggggagaatgtttcctgtggatataattctgattttaaggagtacggggttatttcctttgaccttaatgggagcagacaggtagtacctaattatgcagtaccgaaaatgaatacaagcaccatgtcaggcatttgtgctgcgaataattctctggtactaagtaataaaagttattatgcatggacaacatcaagtggcagtaaatatacatggacggtcaataatggaaggataggctgggcagcctcggaatcgttgcttgcagagaatacaaatcaaaaaggaacaaattataagtgggaaatgtgtaaggcaggcaatatcctgtctgatctggcacagggaaagagtgtgtgggggtatctctacagcaatgaggaggtattgtccgtctgtgagaaagtcgggatttctccgggattcttttctatagatgcgggagcaggaaaacacacttatttattgcaggaatcaggaaagaccataaatgttgacgcaaagataaaacagttaaatgatataaactggatagaaatcggatataaagaaggagatacgtttttcgtttatggtaaagagtatgctattgacagcagtgggcatatcaatgtttcggcagaagatgaatttacatcaacggaaattaaatatccaagtcgttcaatataatagaaattattttaagtttcaataacagggaggtaggattatggcaattacaggtatcaataacagcagttacacatcgtattatgcatcaggttacaagaacacggttaaaaaggcagcttgtgatattcaaaaaacaaaggaaaattcacaggtgagcaaaacagaagagagtcaggaagattatgtaaaaaaattgcaggaaaaaaatcctcaaatagatattgtggcaggaagttcggataaaaatgtaaaaacagctaatcgtacaggaaaaacagatgtgaggattgctcctgagattttaaataggatgatgagtaatccagaggttgccacaaaatatgaaaatatgttgtcaaaaattccagcattagatagatgggctgactcaatgattaaatcaatgactggtagtgaagttaagtatcgtcaggtatggatagataaggatggtaatatgggctccatggttattacaggaccaagcgaagaacaaaaaaaggctgatgaagatagaaaaatcgagaaaaagaaagaaaatgaacaaaaacttgcagaacggagagctgaaagaaaagagaagatgaagaaaattcaggaagatagacgcacaatatttgcaattggtacggatatgaaaagcattacagagaatgttgtagcacaggcagtaggtacagctccatctatcggaggaagttgtgatgttaaggcataaaaggattcggtaaaagggaaatatcaaattggtgcattggttggaactgcgattttggctaaaagattgtgaattgccaatataatcaatagtttcttctatgaaaagataagatgacagggtggaaggctatggagagctgaccgccctgtttttatccagaaaaatgcagaaataatcaagagaaaatcaaaatctttctgctattctgtttcatgggttttatatgtacgaagataggcttctacaagtgcaagaatggtggttatctgatcgcttgtacattctgaaggataaaccaacagtctttggtaatccagattatcaaatgaatagcagttctgtacagaaacaattaaaagcagcagggatcgacacaaacagtaaaaagtataaagcagtactgagtgagatgatgaaaaatggaaacggtgcaatgtttacaaatgttcaggcaattaagaacctgatgagccagtatgacaaaaatggagactggattgatccgaataccggattaacaggacttgctgtaacggatgagaacagaaacagttataaacatatcatttgaggcggtttttaatgcgaaagcctaatgaaagaatggaggtattataaaatgtctagtgtgaacaattatatgaatggcatctatgacaataacatatcctgtaggagttgcatgttctgcgattatgtattttataataaagcaaaatggtaattttttgaaaaaagtttcggattagatgtagtgtttgccgctgaaaccgtagtatatgagtgaagccggaaaggaggcggtgtgatgatagacgatgaaaaaatcatagaaatgttttttgagcgttcggaacagggcatacgggaactggacataaaatatggaaaagcctgtcacaatctttcctaccatatagtagggagcagacaggacgcggaggaatgtgtaaacgacgcttatttaggtgcatggaacgccattcccccagcacgacctaacccattgttgtcgtatcttttgaaaatcgttcggaatatttcgctcaaaatctattggagaaaggaagcagccaaacgaagcagtcattacacgattgctttggaggaaattgaagcctgtattgcagaccagaaaaacattgaagaagaaatcgaggtcagagagttagcctgtatcattgagtcttttttagacacgctgactatcgaaaaccgcgttatctttatgcgccgctattggttttccgacagctacaaggacatagccgagtttgtagggctttcagaaaaaaatatttctgtccggctgacccgtatccgcgagaaaatgaagcaatacttgattgaaagagaggtattcgtatgaacgcaaagaaattttctgacgctatgagcgagcttgatacaaaatatgttgatgaagcactcaactacaaaacgaaaatgaaaaagcctatatggataaagtggggaattatggcagcctgtctttgccttataatttgcgtagttacaattccgcgtttacttaatggctctaatccccctatttctggagatttggctcctatggtttatgtaaataacaagttgtatcaatatacggatagtcaactcgattttacagataaagaaagccagttcacttatttaggggaaatcgaaagcaaagttagctcatcgcaagagccaaaagagaatttccaagccaatgacgatattgtaggtgctaaagtatatcaatatgaaaataatattgtggttttaattgatggtaaatatttcttatatagtcatatggaagatgctgaaaatgaaacggttgaatttgaaggacagttatttaacaaatcggacttatccgaagaaacccttgaatggcttgagtggtataattcgataccgccagaaaaacaacttgctgtcaattcaattccagccgagctatatactgatgacggtgctggaacggttgacgcagaccaagaaaaataattttgattgacacccacaagggacagccgagattgaggatggaaagaagaaaatccgccagtttgagaacttggaaaagaggttgcgtcaaaagttatccaaagaggaacgaagaacacgcaacaaccacctgtataatcaagagggcacttaacagtgaaacttatttcttggagatttatgacgatatatactatatagcattgagttaattctaaacggattttgaatttatttacaaggaggttttatatgtcaatgaatatcagcggattaggcaatacctataatggtattaacacaaatagtaaacaatataaggctttgaaagaaaaaggccggttatctggtattatgcaaaatgaagccatgatgtcagcagaagaaagattgatatatgaaacattcggtggaagagataccattattaagaatctgatgaagcaatttgattcggatggcgatttactgaatgcaaatggagtggcgggaatggatgttaccggaaaaggtacatcatggcagcagctcacgagtgtatccgaggaatatcgtcaaaagatgtttgataatgtgaagagggaatttattaaggaaaacggtatttcaaatggtgatacaactaagcgttcagatatttttaaggattatcagttaagcgtaagtaaagacaaacgtttaagtggtacatggactttagagcaatacgaaggacagtatagagctgctatgtatgcagcagtgaaatcagctaatccaaattggaaaccgggacaaaagtttgatacaagcattcttgataatgtcaaaagagaatcagtggaatctactcttgtcaaaaatggtaataggttagttcgcaattctattgatgtatcagtatagaatacaacatctttggtgctagagatacggtcaaataagctgctccatcatgggaaaagtataaaattaggagctttagataatatcacaagggaaaagttttcaaaaacttctggtaactctttgaaatacatatcatatcaatagatacgataatataaattatgtttgtatttgttgataacaggtttatatcggaaaaattgtaaatttattttctatgtgaattttcatttttgtagggctggcattagaccagcccttgatttcattataatagataaaaagatattgaatatatatgcacggtaaaaagacgattctcaataaatgagattgggaaaaagtaaccttagtgctgttgaaaaaatcaccatagttctaatgaatcttctgcatctacccatatctgcattgttccatcaagatataattttgcatattcaagcggtttatcaatggcaagtgcgttcaatgcacagtctgatccgggtgtggtttttaaatccttttcggcttcccaacagtcaatgcggagcatataaccagcagaagtataaatatcaatgctgtttctgtgtggattgtattctgcaaatattgttctcatcgtatagaatctccttatcattcaatcagtcatttgttacaaaaatcagaagcatttcaatcagttcaccatgtcacttttattttgtgttatactgttttatagatttttcttgcccttgtatttgcccttatcagagttcgtaaacactgacgggacgatataacacaagggaaacaataagggaaagctcacctgcgataaatccagtgttttcaagggcttgcagagaatttaataacaaaatataacagttattaaattccctaaaacaggtgaaatctcaatcggaatttgacgaaggaggttgattgtatgaaaaagttgatagcattagttttagcagtggtttgtgtgcttggcttggttgggtgcaacaacaagacagtcaatattgatttaccttttgaggtaggtgatgttgaaaatatagaaatgtatcactttgttggagcacctgtgtcagcagaaaagaaggtcattgttgccgaagaaaccataaagaacttgtatgatatgtttgaggggctatccctggaactcaaagaagtagaggaaaccgctggagcagagataaccagtttcagatttaacctttctgatggaacaagttatgaactgatttatggctgcgatggagtaaagacaggcaatctgaaatcttccacagataattttgaatactttacaagtgcagatattagctcttattggagcaacactgacttagaggcagttcccgttgaagaaagcgagttgccaaactaagcagaacaattcctgtttttgaaattgagaaatcggaatttggaggtacacgatgataataaaaattgttacaatttcactgatggcagtgttctacatctgctattttgcaaagctgattagtcagaaaaagcaaggcataaagacaggccaattaggaaaaggaaaagagggatttgtcaaatttatagaagtagctcttaaaataatcacatatttgcttcctgtaatacagattatcagtattgtcttttattcagaaacagcacatattgtgttgcaatttacaggagttgtaataacaatgttcggtgtacttgcttttattgtttctgttacacagatgaaggagaattggagagcaggtgtgcaaaaagaagaaaagaccaatttggtaacaacgggcatctattctattagcagaaatcctgcatttttgggttttgatttaatgtatataggaatattgttttcgttctttaattggttcctttgctttgccacaggttttgcagtggtattttttcatttacagatagtcaatgtagaggaagattttttgatagaagcatttggaaatgagtacctgcaatacaaatcaaaagtatgccgatatttaggaagaaaaagataacttctagtttttgaaatcgagaaatcgatatttgtggaggtcgaagtatgggattatttgataaattaaaaccgaataaaaacaacaaagatttctttgaatggttagatttgatcttaaagaatgaattgaatagtgaaataaaagcgattaactttaatttatatgaagatacagataataaatggtctattgaattagtcggcacattttcattcgatagggataatgacgattgggcttgtgatgaagtatttgctacaagagataatccttttatgatagagcgtgaaagtgattggaaatcaatggaaacattttttattggtttattgaatgaatacctttcttttgggaaatatgctggaagtttaaaaaaatatcaagcaataggtattggatttgttgatggagatttacatattttatatgaaagataatgtctgcttgttagcaataaaaatcggtattttggagatgcgtttaaatgatttctagagcagaatatattcaacaaccatattcaggggaatatattgaaaaaatttatgatataaaaagtccatggaattcaactgattggacatggataaaatttaccgaagaagacgatatttggtgtggtgaatttagaggtaaatatagaggggtatcttgttctacaacattaggaattattgttgttttgacttctgattatatgtatgtgctagatatttatggtggtgaaattatggaatattattcacaaccagaatatgtagatataacagtcacaccatttggaaaaattttagttacagacggctatggcattgagatgtttgcaaatactaagattagcgatatggaaaacatagttcttcccattaatgctgataatttgaaatttgttgaatggagagagaatattttaaaaatcagttgttttgaatttttgacatggggaaaagaaatagaactatatttgaattttgaaactatggaatggttgataaacaaatagcgcatgaaattcaagtttgcagaatcggaaaaatcatgattgttaggggctgttggaacgagagatagactgaaaaatcaggccatattttcttgcttttgagggcggttcgagacttgagataatgaataagccggatatggaggatatgaagaaaacacttaaccgaacaggtctaatccatattgctttcagcgtcggcagtaaagaaaaagtggatgaattgacaatgaaactggaagaagcaggatatccggtcgtcagtggtccacgcacaacaggcgatggctattatgaaagctgtgttgttgcaatagaggaaaatcagattgaaataacggtataactttccacttgcagaatttcattgattgagaagtatgattttgttgtcaaggatgttaaaatggatggcaaggttcagcttattaagctgcaaaaaagtgaaaatttttgatttgcagaactatttcaggggaggaatgtggtatggaagattttagtataaacgaaatgcagaaaatgcagagaagcttgcaggataagtacaaggacagatgggaaccgatctgtccggaaacaggacagaacaagatgctttggatggttggcgaaataggtgaagtgattgatattgtcaaaaagcatggtgcagtgaatgccctgacacaggaagaattgagaaaagatctggttgaggaaatggctgatgttcttatgtactacaatgatgtcatgctctgttacggaattacggcagatgaattgaagcaggcatataccgggaagtttgagaagaacatgaagcgttggtaatttccgatttgcagcatcaaagattttccggacatgtactgcacagccgggaaagggcgctttctattttttatgagaacataaaaggagatttgcaagtggatcattttaaattacattccaaatacaagccgactggagaccagccgcaggcgattgaagaactggtgcgcggattccgcgagggcaaccagtttgagacgctgctcggcgtgacgggttcgggcaagacatttacgatggcgaatgtcatcgaacagctgaaccggccgacactgattatttctcacaataaaacactggcggcgcagctctacggggagatgaaggaatttttcccggagaatgcagtcgagtattttgtgtcatactatgattattatcagccggaggcgtatgtgccgcagacggatacctatatcgcaaaagactcggcaatcaatgaggagatagataaactgcgcctgtctgccacggctgcgcttgtggagcggagagatgtgatcgttgtggcatcggtttcctgtatctatggtctgggcagcccggaggattaccttggcatgatggtatcgctgcgcccgggcatggagaaggacagggacgaggtcatccgtgcgctgatcgatattcagtacacgcgaaatgagatggattttcatcgcggcacgttccgggtccgcggggatgtgcttgagatattcccggcaaactatggcgatacggcgatccgcgtggagtttttcggggatgagattgaccgtataacggagattgatgtgctgaccggcgagattaagtgccggctcgagcattttgcggtatttccggcttcccactacgttgtgccgcaggaaaagattttaagagcgtgcgataacatcgaggcggagctggaagagcgcgtgaagtatttcaagggagaggacaagctgctggaggcacagagaatcgcggagcgcacgaattttgacattgagatgttaaaagagacgggattctgcagcggtatagagaactactccaggcatctggcggggcttccggcgggggcgacgccgcacacactgatggattactttaaggatgattatctgattatcgtggatgagtcccatatcacaattccgcagatccgcggaatgtatgcgggggatcagtcacgaaagagcacgctggtggattacgggttccggctgccgtctgcgaaggataaccgcccgctgaattttgaggaatttgagggcaagatcgaccagatgctgttcgtttcggcgacgccgaacgtatacgaggatgagcatgaacttttgcgcgcggagcagattatccggccgacgggactgctcgatccggaggttgtggtgcgcccggtagaggggcagattgatgatctggtgggtgaggtcaacaaggagatcaagaaccaccacaaggtgctgattacgaccctgacgaaaaaaatggcggaggatctgaccgattacatgcgggaactggggatccgcgtcaaatatctccattccgatattgatacgttagagcgcgcggagattatccgcgatctgcgtctggatgtgttcgatgtgctggtgggcatcaaccttctgcgtgagggattggacataccggagattaccctggtggcaatcctggatgcggacaaggaaggcttcctgcgttctgagacgtcgctgatccagaccatcggcagggcggcgcgcaacagcgagggacatgtgatcatgtatgcggataccattacggattccatgcgtgttgcgatcgaggagacggaacggcgccgcaagatccagcaggagtacaacgaggcacacggcattacaccgacgacgattcagaagtcggtgcgggaactgatctctgtttccaagaagatcgcaaaggaagaaatgaatttcaagaagtctccggagtcgatgaacaaggcggaactgacgaagctgattgccgatatccagaaaaagatggaaaaagcggcggcggatctcaatttcgaggcggcggcggaataccgcgacaagatgatcgaactcaaagggatgctgcgtgacctgtagaaaggataagacaatgaagaaaacgtccgaaagaaaatatattaaaatcagaggagcgaacgagcacaacctcaaaaatatcgatgtggatattccgagagacgaatttgtcgtgctgaccggattgtcgggatcgggaaaatcgtccctcgcatttgatacaatctatgccgaaggacagcggcgctatatggagtcgctgtcttcctatgcaaggcagttcctcgggcagatggaaaagccgaatgtcgagaagattgagggattgtcgccggcaatctcgatcgatcagaagtcgacgaaccgcaatccccgctcgacggtgggaacggtgacggagatctacgattacttccggctgctctacgcgcggatcggtgtgccgcactgcccgaaatgtggaaaagagatcaaaaagcagacggtcgaccagatggtcgatcagattatggaactgccggagcgcacgaagatccagttgctggcgccggttgtgcgcggcagaaagggcgagcatcagaagctgtttgagcaggcgaagcgaagcggttatgtgcgtgtgattgtcgacggcagcatgtatgaactgtcggaagagatcaaactggacaagaataaaaagcacaatatcgagatcgtggtggaccgtctcatggtaaaggaaggaattgagaagcgcctggcggattccatcgagaatgtgcttacactggcaaacggactcatgaccgtggatgtgatcggcggtgaaccgattcagttctcggagagcttttcctgcccggactgcgggatcagcatcggcgagattgaaccgagaagcttttccttcaacaatccgttcggcgcgtgcccgacctgtttcggactgggctataaaatggaattcgatgaggatctgatgattccggataaacggctttccatcgcggaaggcgccatccaggtgatgggctggcagtcctgtacagatccgtccagtttcacatacgctattttaaaggcgctgacggaggagtatcatttttcactggagacgccatactgcgaatacccggaggaaatccgccatgtcctgatctacggaacggacggcagggaagtgaaagtccattacagaggacagcgcggggaaggcgtttatgatgttgcctttgagggactgatcaaaaacgtgcagcgcaagtaccgggagaccggttcggaggtcatgaagcaggaatatgagcagttcatgcggattaccccctgcgagacctgtaagggacagcggctgaaagcagagtctctggcagtgacggttgcagataaaaatatttatgagatgacttccatgtcggtgaagaatctcaatgcctttctggcggagatgaagctgggggagcagcagcaccggatcggcgatcagattttaaaagagatccgcgcacgcgtcggattcctgaatgaagtgggactggattatctgtccctgtccagagcgaccggtaccctctcgggaggagaggcacagcgtatccgtctggcgacgcagatcggttccgggctggtcggggttgcgtacattctggacgagccgtcgatcggactgcatcagcgcgataacgataagctgctgggggcgctgaagaatttaaaagatctcggcaacacgctgattgtcgtggagcacgacgaggatacgatgcttgccgcggactatattgtggatatcggaccgggagccggctcacacggtggagaagtggtcgcctgcggtacggcacaggagatcatgaagaatccgaagtcgatcacgggagcgtacttaagcggcagaatcaagatcccggtaccggatgagcgcagaaaaccgacgggatttctgacgatcaaaggcgcacgggagaacaacctgaaaaacatcgatgtgaacataccgctcggaattatgacctgcattaccggcgtgtccggatcgggaaagagctccctgaccaatgagattctctataagcggctggcgcgcgacctgaaccgggcgcgctgcattccgggagagcatgatgcgattctcggcatggagcagctggacaaggtgattgacattgaccagtcgccgatcggcagaacgccgcgctcgaatccggcgacctacacgggcgtgtttgacatgatccgcgatctgtttgcggcgaccccggatgcaaaggcgaagggctacaaaaagggaagattcagcttcaacgtaaaaggcggacgctgcgaggcgtgcggaggggatggaatcttaaagattgagatgcatttcctgccggatgtctatgtgccgtgtgaggtctgcgagggaaaacgttacaaccgggagacgcttgaggtcaagtataaaggaaaaagcatttatgatgtgctggatatgacggtggaggaggcgctggagttttttaaaaatgtgccgtccatccaccgcaagattcagacgctctacgatgtgggactttcctatgtaaaactgggacagccgtccacagagctttcgggaggagaggcgcagcgaatcaagctggcaaccgaactctccaagcgaagcaccggaaagacgatctacattctggatgagccgacgaccggacttcattttgcggatgtgcacaagctgatcgagattttgcggagattgtccgacggcggcaataccgtggtggttattgagcacaatctggacgtgatcaagacggcggattacatcatcgacatgggaccggaaggcggagacggcggtggaacggtcattgcgcagggaacaccggaagaggtggcgcagataccggagtcctacaccggacagtatgtcaagaaatatctggaaaaatagtggaaataaggagaaggcactggacgcaaacgtggaaaacacgcggcatacagtgccttttttgacaacagatgcgctggcatctgcggtcagagaaatgttgtgaaatatatggcatcgaaaattcatatggatgaaaattcgttatacccggggagtacctcccggcgtttggtgtttgcgccggaaggtatgagttatgaaaaattatactaaccgcggaatatttgaggaatatttccggggcggtgtatgtttggtacaccatttagtacgtaaaaaaatataacccgcaaatgtgatgaatacgtgataaaaaaatgaaaaaatatgatattccggacaaaaaatgaagaaattcttatttttttcaaaaatggcggcacgggcgaaaaaaagctttgaaaaatcccagtttttgtatataataatgctgtatatgtaaaaatatgattaaatgcatctttatgtccttttggacgtgaagaaagattcaacgaatagatgaaccattggcagagaaaagaaaggggcagattagaatatgatgagtacggacatcggtatcgatcttggtactgcaagtatcctggtatatattaaaggcaaaggtgtagtgttaaaggagccgtcagtagtggcttttgatcgtgatacaaacaaaatcaaggcaatcggagaggaagcgagactgatgctcggcagaacgcccggcaacattgtagcagtccgtccgctgcgtcagggtgttatttctgattatactgtcaccgagaagatgatcaagtatttcatccagaaggcacttggcaagaagacattccgcaagccgcgcatcagcgtgtgtgtgccgagcggagtgaccgaggtcgagaaaaaagcggttgaggatgcgacctattctgcaggtgcgcgtgaggtggcgattatcgaggagccgattgcggcagcgatcggagccggaatcgatatttcaagaccatgcggcaacatgatcgtggatatcggcggcggtaccgcggacatcgccgtgatttctctggggggatcggttgtcagcacttccatcaagatcgccggagatgattttgacgaggcgattgtccgttacatgagaaagaaacacaatctgttgatcggtgagcgcacagcggaggacatcaagatcaagatcggttcctgtttcccactggcacagaatgagaccatggacgtcagaggccgtaacctggtgaccggtctgccgaagacggtaaccgtttcttccgaggagacggaagaggcgctgaaggagccgacactgcagatcgtggaagcggtacactcggtgttagagaagacgccgcctgagcttgcggcggacgtggcggaccgcggaatcgttctcacgggaggcggatcactgcttcgcggacttgaggaactgatcgaggacaagacgggcatcaataccatgacagcggaggagccgatgacctgtgtggcagtcggaaccggaaagttcgtggagttcctgtccggaaagcgcgacgatgattaagtttgacggcagttatgacgatataaacaacagagagcccttgggatgcgggagcgtctgatggattctggtgagaagcaggcagaagttacaagaggtaacagaaaaaggagcagtctatggtaaagggattgtatacagcgtatacaggaatgataaatgaacagaagcgtctagatgtgctttccaacaatcttgcaaatgcagatacgaatggttataagaaagaaggcacaacgtcccagacatttgcagatgagctggcaatcaagatcaaagatacatcgtcttacggtcttgcgcagaagctgggtacaatcagcatgggcgttcatatcggtgagacgtatacggattacagtaccggaagtttcaaggttaccgataacagtacggattttgcaatcaagggagatggattttttgcgattgcctacacggataagcagggaaattcatccgtaaaatatacaagggacggagcgttcacggtcaacacccagggctatctggtgaccaaagacggcgattatgtcctgaatgcaaatgacgccagaaacggcaatgtgaacggacggattcgggtggatccgacccagaagatcaccgtggatgagcttggcaatatctatcagaacgatcagcaggttggaacgatcggcatcgtcgattttgcggattatgactatctggcgaagtacggtgagaatatgtacgaccttgtgaacggaggaacggtgacggcggcagacggcaggatcgtgcagggaacgctggagtcgtccaatgtgaatgttgtttctgagatggtcaatatgattacgatttccagagcatatcaggcaggacagaaggttattaacacgattgatgagacactggataaggcggtcaatcaggtcggaaatgtatagacggaggtagctgacatatgatgagggcactttatactgcggcaaccggtatgcttgcgcagcagacgaacgtggacaatatttcaaacaatctttccaatgtgaatacggttggattcaagcaggagaaggcagagtttaagtcgctgctttaccagaccattcagacgaagacaacgagtgcaaacggagagcagaaaccgattccggcacaggtgggactcggaacgagagttgcggcagtcacatccgtgtacacacagggagcgctgcaggcgagtgagaatgataccgattttgcaatcgtcggagacggattttttgcagtgcgctgcgcagacggcgagacacgctataccagagcgggagattttgtgtgggcagtgggaaccaacggcgttacactgaccaatccggacggctatccggtgctggacagcaataaccagcagatcgttcttccggccaatataagttccagcagtgtgacagtatcgagcgacggcagaatcggttacacgacagcaaatggaacttatgtgaatatgaaccgtcagattggactgttccagtttaacaacccgagcggccttgagaaaacgggtgacaaccttctggaagttacagcagcttcgggtgcggcaatgaatgagaatacgacagcaggtcttaccagaagccaggttcgccagaattatctggaggcgtccaatgtacaggtggcggacgagatggtcaatatgattatcgcacagcgtgcctatcagttgaactccaaggcaatcacgacatcggatgagatgctggagatggcgaacaacctgaaacgataagcagatgataagcgaacggtaagcggatgataagcggaatggagcgtaaagtatgagtttttcgatagacggtatttcgtcattggtcagcaatgcacagaacagcgcagccgcaggcagcgcgtcggcactgaagaattcgatcagtagtgtgtcctccggctcgagcgaggaagaactgctctcggtctgcaaggattttgagtcctactttgtggaagaggtattaaaggaagtaaaggagaatctcatttcggatgatgacgaggataaggattcttctctcagtacgctgacagattttcacatggacagcacgatcgaactggtggcagatgagattgtggatcaggtgggagaaaattatacgcagcagctttatgagcagatgaaacggaactatggcatagaatagatgccggcagttaagaatgaacgaggcagagggcggtcaccgttagaggtgacgggttctctgcttttttcggcgggaggaatgatttggaaaagttagcaggatatgtggaacatattatatacagaaatgcagacaacggatatacggttctcaatctggtaagcggggaggaggagattacctgcgtgggaatcttctcggcaatcgctgagggggagaacatcgaggcatccggtgactataccgatcatcctacttatggcaaacagtttaaagtcgaaagttttgaggagaaagcgccggaagatgaggaagccatcgaacgctatctcggttccggggcgatccgcggaatcggtctggcgctggcagcgcggattgtgcgcagattcaaggcggatacctttcggattatcgaggaggagccggagcggctggcggaagtaaagggaatcagcgagcgcaaggcgatggagattgcggatcaggtgaatgaaaaacgtgatctgcggcaggcgatgattttccttcagcagtacggcatcacgatgaacctggcagtgaaagtatatcagcagtatggacaggaggtatacgggattatccgtgagaacccgtatcggctggcggacgacattgagggtgtgggattccgcacggcagacgagattgctgtccgggtaggaatccgcatggattctgatttccggatccggagcggaattttatatgtgctgcttcaggcatccacagaggggcatacctacctgccggaggaggaactgaccagaagaactggacagcttcttgaggtcggggaggagcagatcgagaagcagtatatggatctggcgatcgagcggaaaatcatcatgaagcagggcgaaaaccagacgcagatctatgcggcgtccttttactacatggaggcaaatacggcaaccatgttaaaacagctcaatgtcagctatgatgttccggatctggaaatcgaggagcgtgttcgcagaattgagaagcagaccggaatggaactggatgagcaccagatgacagcggtcaaagaggcggtgcgcaacggacttctgattatcaccggaggaccgggtaccggaaaaacgacgacgatcaatacgatcatcaagtattttgagatggaaggacttgatatttttcttgcggcgcctaccggacgtgcggcgaagcgcatgagcgagacgaccgggtttgaggctagaaccatacaccgcatgctggaactgaacggcggtgtggacggtgcggcagggtttgagcggaatgagcagaatccgcttgagacggacgttgtgattatcgacgagatgtccatggtggatatttctttgatgcatgcactgttaaaggcggttgctgttggaacgagactgattctggtcggagatgtcaatcagctgccgagtgtgggaccgggaagtgttctgcgggacattattcgctcgcacgagtgcaatgtggtcatgctgacgaagattttccgccaggcatccacgagcgacatcattgtgaatgcgcacaagatcaatcagggcgaagaagtgacgttggacaacaaaagcatggatttctttttcctgaagcggtatgacgcggatgtgattatcagcgtggtattgcagctgatcaagcagaaactccccaaatttgtggacgcgacgccgtacgatatacaggtgttgacgccgatgcgcaagggactgctgggcgtagagcggttaaacggaatactgcagcgctatctgaatccgccgtctccgcagaagcgtgaaaaggaacacggcgatattctgttccgcgagggggacaagatcatgcagacacggaacaactaccagttagagtgggaaatccgcacaaaatacggtctgtctgtggataaaggaacgggagtattcaacggagacatgggaattgtccgggagatcaacgatttcgcggagacgatgactgtggaatttgatgagggcagaatggtggaatatccatacaaactgctggatgaactggaactggcgtacgcgattaccatacataaatcgcagggaagcgaatacccggcggtcgtcattccgcttttgtccggaccgtcgatgcttatgaaccggaatctgctgtacacagcggtcacccgcgctcggaaatgtgtgacgctggtcggcaatgaggtgacgtttgagcagatggtgcagaacacgtcgcagcaaaaacgatacagcgggctgtgtgaccgactgaaagaggcatagcactgccgcagttacagaacatttcgcgtttggagaggggaatacggagaatgataacgcaggcgagaagcccatttgtttcagaatgcaacggacacagtcccttctttggagcaaaatcccgtatttcttccgtgcgatcgttgtcttaggttccgtgtctttgccacgtttgaacaccccacggaagctgtccgtcaagcagcagacaatgagcggactttctggcagcactaactgcactcacgcatagacatcataaaaccgcgcgaaccggaactcgccggcatctgctattgaaaatagggcagatgccgactcagacatcggcttcgcgcggttatgttttatgcttagagtgcaggtaagtgctgcacaaaagtcctaaaattgtctgtagcttgaggacagcttccgcgggggtgctccaaacttggaaagacacggatcatcgcaaaggcaacggccgcacggattagaaatacacgattttgcgattagaagggattgtgcccgttacatcctgaaacacaaaaggcttccgcctgcgctcacttcatccggacagcttctcctcccgaaatatcctgcgaccgcgttatgcctctttcctgcggttacgacagcagcgctttatcgtttgcaaactcctcgccgctgaccttctcaaactgatggaggagatcttccaccgtcagcttcttcttctcttctccggcaatgtttaagatgacccggccttcatgcatcatgatgaggcggttgccgtgtacgatggcatccttcatgttgtgggtgaccatcatggcagtcaggtggtgatcggcaatgatcttgtcggaaatctcaagcactttggctgctgtcttcggatcgagcgctgcggtgtgctcgtctaaaagcagaagcctcggcttctggatggaagccatgagcagcgtgattgcctggcgctgaccgccggacaacagccctactttgctggaaagccggtcttccagaccgagatctaacgtggcaagcatctcacggtagacgtcgcgctccttttttgtgatgccccaggagagcccgcggctctgtccgcgtctggcggcgatcgccatattttcctcgatcgacatcgtcgtcgcggtgccggtcataggatcctgaaagacgcgtccgagatatttggcgcgcttgtactcggaaaggcgtgtcacatcatcgccgccgatatagatttttccggaatccaccggccacacgcctgcgatggcgtttaaggtggtggattttccggcgccgtttccgccgattacggtgacgaaatcgccctcctcgagagagaggttcacaccgtttaatgcaactttttcgttaatggtgcctggattaaacgttttcttgatattgtctatttttaacatttctgccatggtgttaccgctcctttcctttgcgtgtggatttcagataaggaatggcaaggaatactgccacaacgatcgcggagaaaagcttcagatcgtcggaaggaagctttaaccataaaaccacattcattacaatataatagatgatcgctccgccgattacggaaaacagcgtgtaggcgaaagcgagattcttcccggcgcagagtctgccgaaaaggacttccccgatgatgacggcggcgagaccgatgacgatggcaccacgtcccatgttgacgtccgccgcaccctgatactgggcgtagagaccgccggaaagcccgaccagaccgttggagatcatgagcgcaatgacggtgtgaaggttggtgttgattccctgcgcacgcgccatttgctgattacatccggttgcgcggatggcatgtccctgctccgtgccgaaataccagtagagaatcgcaacgattgcaaaacagaacaggatgcatgtcgcaaaaatctgcacgcgggtgctgttggagtcggacagatagcggagcgagaccaccagagggtacttgtcaacactgacggcctggttggaacagcccatgatgttcaggttgatggaatacagggaaatctgggttaaaatgcttgccagaatgcccggaatgccgagagcggtatgcaggataccggtgatgaaaccggcggccatgcctgccagaaaggcaaaaataagtgctgcccacggactcatacctccgcggatcagcatgacggcaaccgcacctccggttgcaagagaaccgtctacggtcagatccgcaaaatccaacagacgataggtgatatagacaccgagtgccatcagtccccagaccatgccctgggcgaaagcgccgggcatggaacggaagagggcaagcgggtcaagcgacataaaataattcatcaggaaaaacccccttgtaaggaaaaatattattcggcatcaattgccacgtaatcatccggaaccgtgatgcctaaatcggaacagatcgcggcattgtactctttggtgacattcggggcatattcaatatccattgtggatatatctttgccgtttaccagaatgtcataagccatctcgcccgctttgtagccgatgtcgtaatagctgatggagagcgtcgcaacgccgcagccggaacagattccttcttcgccggcgatgacgggaatgcctgccgggcgtgtgatgttgtcgatcgcttcggtgttgcctgccatggtgttgtcggtcggaatgtagatgacgtctacttcgctgacagcactctgtacgacagaggcgatgtcgttggaatctgccacggtgtactccttgtgggagattccgtcctcatccagatactttccgaattccgttgcctggtacacggagttcggttctgcggaacagtagaggatgccgacattcttggcgtctggaaacagttccacgagcatatcttcctgctggtctaacggagccagatcggaggtgccggaaatattttttccggtggcgccggtccagtcgtcaatgtcgagcgcggttgcgtagtccgtcacggaggttccgagtaccgggatcgtgctggtggccgccgcggaagcctgcagggcggtcgtcgcattggcgaggatcagatcgtaattgttggagacaaaggtggtggcaatgctggaacagttcgcctgctcgccctgtgcgttctgcacatcgaaggtgacggaatcgcccatcagtttggtcagggcatcctgaaatccctgcgttgcctgatccagtgccggatgctccagctgctgcaggatacctaccttatacgttttttctccactgccgcacgcggtcatggataagaccatcgtggagactaatactgccgaaatcagtttgtgtgcttttttcataagcatctcctcctttattgcattaaagctttaatgcttttaatagataaaattataatgaggaaaagtatattcgtcaaccgttccttaaaataaagaaagaaaaaattaagaaaatgtttatggcaaaaaaggggcggacatgctaggataaagcggaatcagatgaccggggggagagcgggaaatgcaatgcaggctgatttcgcaacaggaaaagaaaaaacaggacgcggactgcggtgggggacggagacgatcgttggtctcatctatccgccgagatgtccgatctgcgaccgcgtgacggtgccggaatgtgtcccgtgcagaaggtgcgcggatgctgtacggcttgccgaggaaccggtgtgcaagcgatgcggcaagccgctggatggcgagcgggcggaattctgtctggactgcggaaagcgcaggcatgcgtactgccaggggaaagccgtgtttgtgtatcagggaaatatccggcagtccatgtaccggtttaaatatgcaaaccggcgcgaatatgcggcgtattatgcgagggaggcggcagcgctttatcaggactgggtttttaaaaatcaaatcgaagtgatcgttccggtgcccatgtaccggtggaaaaagcggcggcgcggatacaatcaggccgagacattcgcgcgggcgcttggcagggagctggggcttcctgtggacgccgggcttgtgcgccgtgtgcggaacacggtgccgcagaaggagttaaatggcggacaaagagcggcaaatttaaaaaatgcttttcaattagcagcagatatagtaaaatataagaaaatattgctggtggatgatatttatacgacgggaacaacgatagataccgtttcggaggtcctgctgaagggcggcgcagagcggatctattatatttgcgtcagcatcggtgcgggattttgacaggggaattcaggaggattgagaagtatggaagtgagaaattgcaggagctgtggacgcctgtttaactatatggggggagcgccgctttgtccggcgtgtcagaaaaagcttgaggagaagttccaggaggtaaaggctttcctggaggagaatccgaattcaagtgtggagacggtcgctgaggagctggatgtgtcggtgaagcagatcagacagtggattcgcgaggagcgtctgtcactttccgtggcaggagcagacggcattgtctgtgagacctgcgggaagccgatccgcacgggaagattttgcgagaagtgcaagaacaatatggcgaacgcgcttgcagagtcgattcataagccggagccgccgcaggagacagagcgggataaaaaccgcatgcgttttctcaaataataccaagagaatcaacagggcctgggtatcgggctctgttttttgctttgaaaataaatagtgctgtgttataataaaaaaagaatgcataattgcgtgcaattttgacctgcgcaggctggaacggcagggcggagaaaggataactactgtatggtaaatgaagaacgattgcgccacctgattaagatggcacagtttgatacaaatgacgggaaacagtgtaagccgatgacgcagtatgcgagaaaagattatgtttccatgcgtctgctggggagcttcgtgacaggaaccatctgctacgggcttctgatgggaatgtgggggctgtatgcgacggaagagctgcttgcaaagctgaacaagttcgatatccaggggcttgtcatgacagcggtagtgccgtatctggtgtttatggtgatttacctcggagccacgtgggtaatatttaacatgaaatacacagagggacgccgcaaggtgaagaagtattacaacaacctgaaaaaggtgaatcagatgtatgagagggaagaacgcctccggacatccgatcataaagactgggattagagcgggaggcatggaatgacaaccttattggaactcaaagaaaaattagtacgcttctacggaaaatacgaagtgtacattacaccgatcgtcaagtttatcgtggcgtttgcggcgctgatgacgattgacaggaacatcggctacatggaactggtcagctccacaccggtggcgctgattttaggactgctctgtgccatcctgcctgtgggcggcacgatctttattgcggcggtcgtcatactggcggatatgtatgcattatcgattgaggtatgtctggtcgcacttcttctgtttgtgctgatctattttatctattttcgttttgctcccagacagggaatgggcgtattgctgacgccgatctgcttccggctgaatatcccgtatgtgattccggttggaatgggactgctggaggaggcatattctgtatttgcagtgatctgcggtacggtggtttactttttcctcgacggagtccggcagaatgaaaagctgctcggcggtgcggcggaagagagcacggaggcgaattccaagattgtggtggcgttaaaccagcttctcggcaacaaggaaatgtatctcgtgatcggcatcatggctgtgacgctgatcattgtgtatctgattcgcagaatgtccattgcgaatgcatggcagattgcgattgcatccggtatcctgtttgagacgataggtttgattgcgggctatatgcttcttggaatttccggtaagacggtgagcgtgctggtgggcaatgtaatctctcttctgattgcatttgtgatacagtttttgttctttaacctggattactcgagaacggagcggttacagtttgaggatgatgagtattactactatgtaaaagcagtgccgaaggctgtggtatccggcaccaacaagcaggtaaagcgtttcagcgggaaggacgaaaaggaacgtctcacgaagaagcgttttgcggaagagatggatatcgacgaagaattattagattaaggaagtggaccgcgtgcagaacatgttagctaccctcgatgctttctggcagaaagcgtctctttatatgaatcttccaaaaatctccataacagatatcgtggagatcataatcatagcgtttctgatctactatatgctggtgtggatcaagaataccagagcatggatgctgctgcgcggtttgatggtgattctgctcttcgttctgttggcagcattgttccagatgaacacgatcatctggattgcaaggaatacgttaaatgtcctggtgatagctctggttgtaatcttccagccggagatgcgcaaggcgcttgagaatctcggacggaaaaacgttctggcgttcctgttttcctttgattcctcaaaggaggatacggggaagttctcggataagaccattaatgaaatggtcaaggcgtgctacgagatgggaaaggtgaagaccggagccctgattgtggtggaggatgagattgttctctcggaatatgagcgcaccggaatcgcggtggacggtattctgacaagccagcttctgatcaatatttttgaaaaaaacacaccgctccatgacggcgccgtgattgtgcgcggggacagagtcgtggcggcgacctgttacctgccgcttacggattccctgtcgatcagcaaggatctgggaacgagacaccgtgcggctgtcggaatcagcgaggtgagcgattccctgacaatcgttgtgtcagaggagaccggaagagtgtcgattgcgctcggcggtgaactttaccgcaatgtagatgccgagtttctgaagaacaagctgacgtacatccagaggcgggaacgggaattatcgaagattgcattgtggaagaggaggctgaaagatgctaaaacggctcggaaaaacgataacaaataattttagcctcaaaatactggcggtcatactggcggttgtgctgtgggtagtcgtgattaacattgacgatccgacgacgtcaaagacctataccaccaatgttgtagcggagaatacggactatatcacatcgcagaacaaatattatgaaccgctggacagcagcaacgtagtgtcattccgcgtgtcggctgcgcgcagcgtgcacgatgaattatccaatgccgatttttccgcaacggcggacatggagaatattgagtacgatgagggaagcggaatttaccgcgtgccggtgacgatcaccgcgaagcggtatagcaataaagtctccgtcgtctccaaacagctctatctggaagtggcgctggaagaccgcggcacctgccagaaggcgattacggcggcaaccaagggaaccgtgatggacggctgtgcactcggcacggtacagatcgtgggctccaacctgttaaaggtttcgggaccggcatccatcgtcagccagattgatacggcggtggcgacgatcaatgtggaaggtatgtccacggatgtgacggattccgttgtgccggtgttatatgatgccgacggcaacgtgatcgacacgacaaagctgacactcagtctgtccacagtcaatatttcggcacagatcttaaataccaaggatgtgccgctggagtttgaggcgaagggcgaaccggcggacggctatgtgcttaccggcgtggaaagcagcctggataatgtgcgtatcaagggcgaggcggcaacgctcaataccgtcagtaagatcaccattccgcaggaggtgctggacatttctggtatcaccgaggatctgaccacaacggtggatatcagttcctatctgccgagcgggacgtcccttgtgctgaattcggatgcaaaagtagaagtgatcgcgaaggtggagccggttgtcaaggcgacttacgaggtgccagtggcaaactttaccattcagaatgtgcgcgacggttacaatgcaaattacatggagagcacggtcgcggtagagatcagcggagcggagagcgagcttgcgggaatctctgcaaaagatattaccggaacggcggacgcatccaaccttggagcgggcgagcatcacctgaatgtgcagatcacgctggagcaggagcactgctgggtgattggaacagtgacactgccggtgacaattaccgaccacaacaccgccgaaacgggtacttcggataatacggatacgacagacagtgagagcaagacgaacgatacagccgacaccgccgctgcaggcgatgcggctgacaagtcggataaaaccgataagacggataagacggataagacggtcactgagaacagtacggctggaagtgatgtggagagaagcagcaacaatccgtaaaaagtaagaaacatggaggaaatagaatatggctagaatgtttggcacggatggcgtgcgtggcgtggcgggatcggaactgacgatcgaactggcaaccaagcttgggcaggcaggcgcgtatgtgctgacgaaagagacggaacatcaggcgacaatcattgtcggatgcgataccagaatatcgggaggaatgcttgccagcgcgttgatggcgggaatctgctccgtgggtgcaaacgccatttttgtgggggttatgccgacgccggcgattgcctatctgacaagaaagcataaagtagatgcgggtgttgtgatctcggcatcgcacaatccgatggaatttaacggaatcaagttcttcaacggcgagggctacaagctttccgatgcactggaggatgagattgaagcgctgatccgcaacaacatgaaggacgtggtacttccgatcggatccggcgtgggaaagatcgaataccgctttgatctgaaggatgaatacgtgaaatttatggaaaaatgtgttccggtcgatctgcacggcaaaaagatcgtggtggactgcgcggagggcgcgtcgtattacacgtccgtcaaggcgctcagcgatcttggtgcggaactggtggcgattcacaccgacccggacggaaccaacatcaatgcgaactgcggatctacccacatggatgagctgaaggcacgcgttgtgtacgagaaggcggatgccggtatcgcgtttgacggcgatgcggatcgtatgcttgcggttgacgaaaagggcaatctggtagacggcgatcaggtgatggcaatctgcggcaactacatgaagcagaagggcagactgaagaagaatacgattgttgtgacgatcatgagcaacctgggatttactctgatgggagaaaaagagggaatccacgtagagaaaacaaaagtcggagaccggtatgttctggagaacatgcgggaacacggatacaatatcggaggtgagcagtccggacacgttattttcctggatgacaatacgaccggagatgggcttttgagcgccctgcatcttctggaagtgatggtggacaccggaaagccgttgtcagagctggcagcgatcatggaggttctgccgcaggcgcttgtcaatgccaaggtgccgaatcacaaaaaagagcattttatggagtatccggagattgcggatgcaatcacagaactggagaaaaagtttaacggtgagggacgcgtgctgatccggccgtccggtaccgagccgttggtgcgcgttatgattgaggggaaagatcagaaagtcattgacgaggaagcgaagagacttgcggaattgattacgcgcattatgttgtagagtcagaggatttgttaggaaaattattcattggagggaagagagcatggtaagtcagaaagtcacagtcaagaatccaacgggactgcatcttagaccggcgggaatcctgtgcaaggaggcgatgcagttcaaatcgcacatcacattccgataccgcgagaatactgcaaatgccaagagcgtgttgagtgtgctcggtgcatgcatcaaatcgggcgatgagattgagctggtatgcgagggggaagacgaacaggaagcgcttgcggcgcttgtgcatgccattgagaacggacttggagaatagaagagtaagagaggaaaaccggatgaaaaagatactggttaccggctgtaacggtcagctggggcgcgcaatccgcgcagagtatgcaaaggaagacgtaacgtttatcaacacagatgtggtggagggcgatggtgtcacagcacttgacatcgccgatgtggatgccgtgctggcgcttgtccgcgccgagcgtccgcaggttatcatcaactgtgcggcgcacacgaatgtggatgcctgtgagacacagtgggatgcagcgtaccgcatcaacgcgatcggtccgcgcaaccttgccatcgctgctgcggaagtcgacgcaaagctgatacatgtgtccacggattatgtgttcgccggaaacgggacgagaccgtatacggaattcgatgagccgggcccggtcagcgcatacgggaaaacaaagcttgaaggagagcgcttcgtgaaggcgttcgcaagaaaatattttatcttccgcacggcatggctgtacggggacggcaaaaattttgccaagacaatgttaagactgtcggagaaccatgaggaagtgagcgtggtatgcgatcagctcggttcaccgaccagcgcagtggaacttgcgcgtgcgattcatcactatgaaccgacggagaattatggactgtttcatgcaacctgcgagggagataccaactgggcagcatttgcggaggcggtatttgcgcgtgccgggaagaatacctgcgtcagacatgtgaccagcgaggagtatgcagcgatgaatcctgcttcagcgaaaagaccggcgtattccattctggataattacatgatgcgcctgacggacggctatcgtatggctgactgggagagcgcgctggatgaatatatgcagcatttgggctgagagagataccgacagaaaagtgaaaggataaccggaacggatgaaaagtgttgtaatgcgggatttgcatgactatgtgagaaaatactgggggctgcttgctgcgtcaatggcggcaatgctgatctgtttcggttgtcttgttttttgcggaaatatccgcattgatacagaagagttaatcaatcacccgggaagcagtctgggatggcttgcgatcggacggtgggagctggcgtggctcaagcgccttctggggcttggcacacatcaggtcataaaaagcggggtattgttctttctgtttttctggctgggagccaatttcctgacgttcggcatttatgagcgttccgggaaaaagaaaagccggtactggattttcctgctcctttatgcaacgtccaacatctggtgttatcagatttacttttccctgcagcaggcggaggtggcgcttgcaatgctgctgttgattgcagcggcgtttctgatgaccggaatcggcaccggaaccgtaatgaatctgcttcgggcatttgcggcgggtgttctgctgtttatcggacttggagcgtatcaggcgctggcggtttattatgtcgcagtgtgcctggttttcttcctggcggagctgaccgcggagcaaaagaaggacggatacctcaggcagatcctctggatgatcgcacatttcggtgtggtgtatctgtgctatcactggtatatgagcacgtttctggtgtcttcggattatatggacagccagatgggctggggaaggctgcctgtgctcgcatgtatcaagaatgtgctgcgcacgctgaaaaatctgctgctcggccatggacccagaaacttctctttttacggatgtggtgtaattctcctgcttgtgcttgctgggagcgcgtttgcctgccggaaaaagcggaatcttccgtgggagaagaaaaagatcgtgtatgcattgctggggctcgcgggacttgtgcttacgccgctgcttctgacggcatacatgggggagatgatcgtgacaagatcacagtttgcacttccggtggcgggagcgttcctgggaatgtatgtgacggaacgactggcggaactctgggatgcaagagaccatggtacgggttactggctgctgttcgtctgcagagtgtgtatctgcgttgcgattgcggttcaggtgagttacgatctgcgtcttaccgtgacagatgagatgcgctgcagggaggatgagcaaaagacacagcagctgttagaatgccttgccggggcagacggaggggaactgccgcggcttccggtagtgtttgtcgggtatcaggaggcggatctcccagagtggtgcaggcggactgagatgtatggatggtcgttctatggctgggattacagcatggagaatccgaccggtacgacacaccgcatctgcggatttgtacaggcttacactggcaatgtgctgcgggaagatgcgacggaagagcagaagaagcgtgcggtggaactggcgggacagatgaacgatttcccggaagagggatcggttctggtgacggaggattgtgttgtcgtgcggctgtcggagattaaggagcagatgcggacagactggtggtagaggcgatgtggtggtctgtgtatacacaagcttgtgctggaacggaatctatgataaaatgaagagacttatggcagtgaaacggccatggataatagagactgcaagtattgaaaataaatggaggttgagatgagaacttatttggtaacagggggagccggttttatcggttctaattacattcactacatgtttcgcaaatacggagatgcgatccgcattatcaatgtggatgttctcacgtatgcaggaaaccttgagaacctgaaggacattgagaacaatccaaattatacgtttatccgggcggacattacggataaggaagccattgcgaagattttcgcggagaacgacattgaccgtgtggttcacttcgctgcagagagccatgtagaccgcagtatcaagaatccggaggtcttcgtgaagacgaacgtgctcggaacggcagtgatgttaaactgcgccaaggcggcatgggaacttccggacggaacatttaaggcggacaagaagtttttacacgtatcgacggatgaggtgtacggctccctggaggatgacggatcttatttttatgagacgactccgtacgcaccacacagcccgtattcagccagcaaggcatcctcagatatgttggtaaaggcatacattgatacttacaagttcccggcgaacatcacaaactgctccaacaattacggaccgtaccagttcccggagaagctgatcccgctgatcatcaacaatgcactgcagggcaagaagcttccggtgtacggcgacggtaagaatgtgcgtgactggctgtatgtcgacgaccacgcgaagggcatcgatatggtgcaggaaaagggacgcctcggtgagacttacaacatcggaggacacaacgaaaaacagaatatccagattattgagattattattgataccttacaggagatgcttccggcggacgatccgagaagaaagctggtaagcaaagatctgatcacttacgtggcagaccgcaagggacatgacagacgctatgcaattgcaccggacaagatcaaggcagaggtaggctgggagccggagacaaagttcgaggacggcatccgcaagacgatcgcgtggtttttcgagcacgaggactggatgaagaatgttaccagcggtgattatcagaaatattatgaggatatgtatcagaacagatagttgatgcaggcagcagtaccgccttttgggcgatactgcttgtttgcgttttaaattaagaaaaaattaagctgtgtccgttacaaatgttaatggacgtggcgtatattggataaaatgggaggattttcagatgaagggaataatacttgccggaggctccggtaccagactttatccgctgactaaagcgatttcaaaacagatcatgccggtgtatgacaagccgatgatctactatccattatcaacgttgatgcttgcgggaatccgcgaggtgttaatcatctccacaccgcgggatctgccggtgtttgaggagcttttcggagacggaagccagctcggcatgagtttttcctatgcagtacaggagcagccgagaggtctcgcggacgcatttatcatcggtgaaaaatttatcggaaatgatgcggtggcactggtgctcggcgataatattttctacggacagagcttttccaaagtgttaaagagcgcagcggagcgcacggaaaaggagcagggtgcgacgattttcggctactatgtcagagatccgagagagtacggcgtcgtggaattcgatgagaatggcaaggcgctgtccatcgaggaaaagccggagcacccgaagtccaattatgcagtgccgggactttacttttacgataacaatgtggtggagattgcgaaaaacgtcaagccgtccgcacgcggggagatcgagatcacctcggtcaacaacgcttatctggagcgtggaacattgagcgtggagacgcttggaagaggattcgcatggctggatacgggaaatcacgacatgctgcttgccgcggcagattttgtgtctgcattccagaaacgtcagggcttatacatctcctgcattgaggagatcgcgtataagcgtggttttatcgacagagaccagctcatcaagctggcacagccgctcttaaagacggattacggcaaatatctgatggaaatcgcggagggattatagaacatgggtaagatcaaggtaacagagaattgcaacggcattgagggactgaaggtcatcgagccggcagtattcggcgatgcgcgcggatattttatggagacttacaattataacgattttgcggaggcggggattgactgccagttcgtgcaggacaaccagtcagcatcgaaaaagggcgtgctccgcgggcttcattttcagatcaattatccgcaggacaagctggtccgtgtggtaaacggcgaggtgtttgacgttgcggtggatttaagggagggatcgaagacgttcggcaaatggtacggcgtgctgctttccgcggagaacaagaagcagtttttcgtgccgaagaattttgcgcacggatttatcgtgctgtcggaggaggcagagttctgctacaaggtaacggacttctaccatccgaacgatgagggcggtattctgtggaatgatgccgaggtcggcgtggaatggccgatgccggaaggaatgacagcggcggatctgatcttatccgacaaggataaagtgcagaaaagcttcgcagaatataaggcggcgcacggcataaagtaaggaaaaacatgcgcctgcagagggatagaaagagattaggagaacatagatggcaggaaagaagaaggatacatcactgcttcatcatctgatcggaagtagaagcctggtatggaatctggcaaaaaatgacatcaagaagaagtttgcaggctcctactttggtgtggtctgggcgttcgtccagccggtaatcacggtgcttttgtactggttcgtgtttgagaagggactgaattccaaggcgacggatcttaggaccggaattgagattccattcgtgctgtggctgacagcgggacttgtgccgtggttctattttcaggaagcgctaaacggcggcaccggtgttctggtggagtacagctatctggtaaaaaaagttgtgttccagatcgatatgctcccagtggtaaaaatgatatcggcgctgtttacgcatctgttttttgtggcgtttacgattgtgcttttcatctgtatgggatatatgccggactggtatgcgctgcaggtcatatattattcgttctgtatgattctgtttgcgacagggcttgtgtatgcgacgagtgcggtgacggtatttttccgcgacatgaaagaagtggtgggaatcctgttgcagattggcatgtgggtgacgccgattatgtggaactttgagacgatggtgcagataccgggatgggcgattgccgtgttaaagctcaatccgatgtactatattgtttcgggataccggaacgcgctgatcaatcatatcggattctgggaggatatggggcttaccgtatatttctgggttgtgacggcagtgctactgtttctcggaacgactgtgttcaagaagctgcgaccgcattttgcggatgtattatagagaggaatttgtaactgaatggatgagttagcaatcagggtagaagatgtcagcaaggtataccggctatacaacagaccctcggagcggctgtttgacgcactggggcttgcgggaaaaggcagattcaaagaacatcgggcactcgaccatgtcacgttcgatgtgaaaaaaggtgagacggtcggaatcatcggaacgaacggctccggcaaatccaccatcttaaaaattatcacaggcgtgctctcacccacaagcggtgaggtcgagatcgacggaagaatctcggcgctgctggaacttggcgcaggctttaacatggaatacaccggcatcgaaaacgtatatctcaacggcatgatgctgggattctccagggaggagatggatgcaaggctggacgatattctgaaatttgcggatatcggtgaatttgtaaaccagccgtgcaagacgtattccagcggtatgtttgtgcgtctggcgtttgcggtggcgatcaacattgatccggagatcctcattgtcgatgaggcgctgtcggtcggagatgtgtttttccaggcaaaatgttataaaaagtttgaggatttcaaggcggagggcaagacgattatttttgtcagccacgacatcagcagtgtggcaaaatactgtgaccgcgtgattcttttaaacaagggcgtcaagctgtcggagggaaatcccaaggacacgatcaacctgtacaagaaagtgctgttaaatcagtcgcagaatattgcgagcggacaggtgcttgcggacgcgaaggaaaatgggacaaagaagctgtggaaatccaactatgagttgaatccgcaggtgaatgaatacggaaccggggaagcggaaatcattgattttgcggtgattgacgagtacggaagctatacgagctgtatccagaaggggacgtcttttactatccgctcaaaggtgcagtttcacaccgatattcaggatccgatttttacctatacgtttaagaccgtgcagggaaccgctgtcacgggaacgaacaccatgtacgagaaggtcggcgtcggactggcacgggcgggagagatctacgtggcctccttcaaacagaatatggatctgcagggaggcgagtatctgctgtccatcagctgtaccggctacgtgggaggcgagttccgggcgtaccaccggctgtatgatgtggtgggcgttacggttatatcggacaagaatacggttggtttctatgatatgaattcggagacgaccgtggagcgtgtggaggaatagaatatagcacagagagatggaggaaaaaagatggagaatgcacagattctgacagaattgtatgaagttataaaacagaatacaccggatcagtatgccagaatcatcagagagcgggcatcctactcttttttgtaccatttgtcggaaattcgtcagaacctgattggctggctgccgattgacgcgacgaagcgtgtgcttgagtgtaatcccgagtgtggagcgcttacaggaaagcttctttccatggcaaaggaagtagtttgtctgataacggatgacagacaggaacagattctctctgcacggtttgcaacggacagccgcgatgggcgtcttattttcacacgggagattccgacagaaacgcagtcatttgatgtaattcttattgcgggaagtttctaccggtggcagaatcagttgacagatctgagaaatctgctttgtagggatgggtatctctaccttgcagatgcgaaccgtatcgggctaaaatatcttgcagggtgtcaggaagagtatgtgggcggctattttacagggattaatggttattctaatatagattgtgtggagaattctggaaggtcatatacccgcagtgagtatcagagactacttacacaggcgggctttgatgatttgaaatggtattatccctatccggatcacaagtttccgtccgtgatctactcggatgactggctgcccgccgcgggagaacttgcagaagggcgaagtaactatgacagggacagggtcgcatgttttgacgagcgcgtaatggcagataccctgttggcagaaggtgtgtatggaacatttgccaattcatttctgattgtggcagggcaggagggatagagcggttggatagaacgatttattccaaatattccaacgagcgggcagaacgattccgcatccggacagacatcgtggtagatgttgccggaagaaaaacagtatataaatatgccggaacgaaggcggcggatccgcatgtacggcggatagaagagtgcttccggcagctgcaggaagcctatcgcggcagtcggatccgtttttgcccctgtgaagtggaagaattacaggcgggaagccgggtcagctctccgtttgtgaggggggagaccttacagagcatgatcgagcgcagtttccggcagggcgactggagcacagtagagacaatcatacgtctatatggcagacgcttgatggaggcggggggagacagcccgtttactgtgacggaggaattccggaatgtttttggcccggcaggacaggagaatgcgtacatctgtgcggatgtgagtgatgtggatatgatcttttccaatatcttcgtggagacggggaatggcgggacggttttggatgtatcggcagactggaccgttattgactacgagtggacatttccatttccggttcccaagaagtttgttctctatcgtgccatctattttgcttattaccagattttcaaggctcagggaagagacctttcggagtggcttgcgatggtggacattaccgtggaagaagcggcacagtttgcagagtgggagacacattttcaggagtatctgctggaaggaggttttccggtgcgcaatatgcagcgcattatgggaacaaaagtcataccgtttgaagagcttcttgccggagagcagacaacagacggagaagtggtgaaagaatcccgatggatccgggtgcgcaggctgctgtatcatatcgatcgactggaacggcaggatgggagtgtgatctgcagtggatgggcactggcaaaatgtctggacggaaggtgcattccggttaatatccggatatatggtccggatgaaaagcagatccgggcagatgtaacccggagtgaccgggcagatgtggcagaagcgttaaagctccggcgtgtggatcgcccacagtttgggtttgactgtgtgtggattctgccggcaggacagaaatggagtattcatttttccatgggaaaccgtgagatcatctatgagggataaagtgaggaattgatatgtaccaatcaaaagaaaagatccagacagtggtgctgtttctggcggatctggtatgttttgtcatcagctatttcttcggaggttatctgtggctggtgcgttaccggaatgtgtcggtaataaatatgaagaccgagctgatggaaagcttcggagtggtaatggtcatctacatgctggtgcttctgttttcggacattgagaagaattttatacgacggaacctggcaagggattttatggcggcagtggaagccagcgtagtcatgatctttgtgacggcactgacaatttttttgcagcacaataatgcagatgcttcccgtggagtgtatttctgtattgcagtggttaatctgatactgttttttataacccatgccgcgatcaagtattaccttctaaagatctataggaataaaagaggaaccagccagatttttctggtcacaactgtggaccgtgtgctggatacactgacagagatcgaaaatgcgaaggactgggcacaccgcctgaccggaatcgcggtcattgatgacaatcagattggcagatggtatgagggaattccggtcgtggcaacttacgataccatgtaccagtatgtgaaggaacagattgtggatgaagtatttatcaatgtaccttacgatacgggggaatcactggcagaggttgtcaataattttgaaaatatgggagcaacggttcatataacgatcgaactgctgcgtcattttgatgagtatcataagagttttaatatgatgggcaatgtacccgtcgtaacattttccaatcagtattacgactggaaaatgttatttgtcaagcgtctgatggatatcgcaggagcgattgtcggactggcaatcacagcagtcgtaacagtatttctggcaccgccgcttttgatcgagtcaccgggaccgctgttttttgcacagaagcgggtcgggaggaatggtcggtttttcaagatctataagttccgctccatgtacagggatgcggaggagcgcaaaaaagaactggagagtcagaatgaaatgaacggctttatgttcaagatgaaagatgatccgcgtatcacgaaagtgggaaaatttatccggaagaccagcattgatgaactgccgcaattctacaatgtattaaagggcgatatgagtctggtgggaacaagaccaccgacagtggatgagttccggcagtacgaatctcatcagaagcgcagactgagtgcaaagcctggaattacaggactttggcaggtgagtggaagaaatgaaatcaaagattttgaagatgtcgtaaaactggatgtgcagtatatcgacaactggagtattggattggatatcaaaatcatactaaagacgatcaaggttgtatttgaaaaaggtggagaataaggaggcagaatcatatgaaccagaagtatcagttagacagggaatacagtatagcggagattattcaatgtaatctacgcagatggtggcttgcattgatctgtgcagtggtgtgcgcagtagtccttggtggatataagtacaaatctctcgaaccgtatctggagcagaatatttatgagaacgtcagacaggttgtggcaaccttatatgtgcagacgtacagtgatgagagttccactgagcgtgcaaataatctcattcgtatcgcggaaagcaaccgtacctttgaaaaggtaaaagaaaaacttggctgtgatattgactataagacttatcaggccctgtttcggatggcgcaggaagagacaggagatattgtgctgctctatttacagtatccgattgatactggagatttcagtattgcagaggaagaggatgccattgtgtttgcacaggcggttgtggatgcaacagcagagagtgcaacagaacttaacggacaggagtgcttttctgtgatcgatgcaccgtatgcaagtcaggagaataaaaaggtagagaactactttatttctgaggacgatttcaaccgtggtgtgatgaagggactggttgccggatttttattgggaattattgcagaagtggcattatactctttttggcttgtgttatatagaaaaccaaagagtgctgaggaggtatgccagattctggacgtgccggtgattgacgatgtgaaaacacgaaaggtcagtgaggaggaagtatacaaaaaggtttctttattcttacgaaagcatatgaaagaaagaacaaacggatgcatgcgcattaattgcattccgattggaaccgtgaggagagacgctgctttaaagcttgcattcagctgcgcaaatgagcagaagaaaacactgtttatagatctggctatcgatgcagagggaaaagatgcgaaaaattcaattagtcaatatattcttggggagagcggagagccggtaccgagtgcattgaatggttatctggatactatatgtcgtgatacggcagaggaaaagaattttgatgttgtgatgcatgaaaaattcgccgcttatttaaacgagatgagcgaaaaatatgattatattgttattaacagcccaaatgcaggagcaagtgcagatgcttatgcggcttccaggctttgcaacagtagttttgtcgtatgcacaagaagcggtgtggacaatgagatgctgtgtcgcctgaagaatacggcagatgcgcaggaaatcacaattgaaggggttctggtatatgaagggtagtgacgttctctatctgagttgtgcactgctttttgtcccggtgctgatcggcagtttctgggtacacttgttacagcttgagggaacggtaaaccggtttctgcatgcctgggtgctcggctttacgaccatgctggctgtggcacagctgctgctggttccgatggtggcattgcagcgcacattgtacgaagcggttatgctgtggaaaatcttgctggaggtgctctcggtgatttccctgatcttgctctgtggcagggaaatccagaaaagcggaaaacgggatgaccggggaaaacggcagaagatgacagcgtggacggctgtaattggcattgctgcggcggtgttgatcctgttacaggcatatatcccggcgagatatcagcacagtgatgatgatgatgcgaggtttattgcggaggaagtatcggcggtagtacatgggagcatgtaccgcgaggatacgatcacggcagattttatgtactgggataccggggaggtgcgcaaggatctgacctcaccgtggacgatgttcgtggcaatgatggcatacgatggaggaatcgctccggcagtactttcccatgcatatctgccgtttttcctgatccttctgtgctatgcactctatacactgatcgggcagaaactgtttgacggtgactgggaaaagacaggcgtttttctgatcctgctgtcagtgatttacctgtggggatatacatcgacgcatacgctggcatcgatgatcctgcttcggatctggcagggaaaggcagtctgcgccggttttatgatcccgctgtttttctatctgttttatcgtgtgatgaggccggattatgagaaaagatggctgcccctgttttatgtggcagctgtgggagcgtgtctgttgtcgggagtcggaattatcacgacaccgattctgcttggaatctacggttttgtggatttctgctgtcacagggactggaaaaagacacttatgatttttctggcagcagttccgtgtggaatgtatctattgtactatttgaggtaagagaaaatgatgacatacatgttgggtgtctggggagaatttctgaacttcatagggggaagagtgggcgctattcactttgtattgtttgcagcggcatcactctgctgttttttccttggaagggaagaacggaataagctgttctggccatcggtgctggtcggtctgtttttctttaatccgtttttttatcagtatattggcacccggtttttaagtggcatctactggcgactactctggatgctcccctgctctttcgtgattgcctacactctgacgaggattctgttccggtttcggaaaaacgtatggcgcatggtggcactggtgctggcgtgtgtctgtattgcagtgaacggacgcccggtcttatcggcagagacttactcggagagagagaatctttatgaacttccggatgcagtgatgggaatctgcgattatgtgcaggcacatctggagggatggcaggagacaatgattgtcccgaatgaactgctctgtgatatcaggcagtattcttcggccgcatgtcttttatatggaaggaatgccggcggatttatctcgatcatcggcgatcgggagatgcaggtctatgaggagatgtcgaaagagaacccggatgtggaactgattacggacattgcgaaggaaacgaactgcagatacattgtatttaatacgtcatttcatcagataccggaagatttgcgcggctatgggtatgagaaagtcgctgtgatcgacgagaactatgccatgtattgcagaatcagcgaataagcagcagggatatgaggaaggcagtcagacaatatggaaaaaataaaaacgattttacggacaagtgactgggaaaaagtcggcattgcagctttttatggatattttgcgatcaatatcctcatgaaggcatttgcctatgatcatggggatgatatctacaagtttttctttatttttgccatgacattctgggcaatcaaggttgtcacgacaaagtataccatacgtgagactgcatggattgcggtgttgctggggatcggtctgatgctctcggttatcaccaaacagaatacgtggctgttgttgtttatgacgatcatcgccatgaaaaactgtagtttccggcagatgatccagattgctgtctatctgcgcgtgttttgtctgtttgttctggtgctgggctcggcatttggtgtgtttgacatcggatttaagacgacaccggataccaattatgtggagattccggtgtacagttttgccatgaacgaaccgaatacggcatttctggcagtttttttgacaatactgcttttgttatactataattatgaaaaattaaatctctggtggttcatcggaacttcggctgtggcgctgatcttctatgaactcacgttctgccggacaggaatcgcggtatttttctttacctgggcactgatcatttttgagaagattgcaaaggacaggtataaagtaatttttacgctttctgttccggcgggagccatcttcagccttctggtgatgattttttatgacggaggcaactcgtttatgcacctgttaaatcatctggtatcgggaagaagctatattatgagcagctactataaggcacagggtgtttctctgtttccgagggtacaggaactcttttacggagagtattatggactgatcgataatacttatatgtatgtattcctgtattgcggcgggcttgttgcagtattcttctttgtattggtgcagaagacactgatgcgcctttatcgtgagggacattataaagaattggctatgatcacggcatttgcactctatggagtgttagagcagtttgtaatgaacggttttatgaatccgttcattcttctgtgtggaattctgctgtatccggatattctggaccagaacactgcgggcatagagaaatgaggaagatatgaaaaattaccggattttacagatacacaatttttatcagatcccgggcggagaagatgtcgttgtacgcaatgaaaaacgtctgctggaagagcatgggcacaaagtctacacctattaccgttccaacagtgaactgaatgaaaagggaattgctggaaagctgttattgccgtttacagcagtcttttccttgaaaacatatcgtgaggtaaaaaggctgatccgtgagaacaacattgacatcgtacatgtgcacaatacgcttacgatggtcagcccgtcagtgttctatgcggcattccgctgtagggttccggtcgtacagacactgcacaattttcgtatgctctgtccggcgggttcctttttccgggataatgtcatctgcgaggagtgcgtggcacatggaatgcactgcgcgatccgtcacaaatgctaccgcaacagcaagttgcagtcttttgtcagtgcggcgatcttacagattcaccggtttgtggggacataccggaaagtcaattttatctgtttgacggagttcaaccggaaaaagctgctggagtccctggataccagacgcgagattgtaaaggcagaccgcgtctacatcaagccgaactttacctttgcagaagagattgtgccgaatgaagtacaggcagaggaggaatatttcctgtttgccggtcgtgtggaggcactaaagggcattgatattgcagtaaaagcatttgaaaaactgccggataaaaaactctatgtggcgggaaacggaccgatgatggaagagatgcagacttatgtcaaggagcatcatatggacaatgttaaattccttggatatctgcagaaggaggagatgtccgagaaattctatcaggcgaaggcggtcatcatgacatcgcagtgttatgaggcgtttgcgatgaccattgctgaggcgtattcttatggtgttccggtaatcgcgggcagggtcgggaatatggaaggtatggtaaaggatgggattacgggcgtgaagtttacctataattcatcggaggatctggcagagaaggtcagaaaatttgacacgatggatctgtctgtgctcaagaaaaatgcgagatctttttacgccgacaggctgcgcccggaggataattaccagaaactaataaagatctatgaggatatatcaaaatgataaaagctgtatttatcaccaatattccatctccgtatcgtgtggatttttttgcatacttgcaggagcattatccggaatatgagtttcatgttattttttccggtgcaggaatggagaaccggaagtggagtgtggaacttgccgaactgaaaaatgcacattttttaaagtcaaagacgatcatcatccgcaaacgttttgatgaccggtatatatttcttccggtcggcgtggaaaagacactacaggagatccatccggatctcgtgtttgccatggagtataatccgacgatcctgcgagcggtgcactggtgtcagaaaaaaaagattccgtttatcagctggacagacggtacattaaattccgaaaaaaatatcggaaaggtgcagcgtatgtcccgcagttatattataaagcgtgcggcagcgtttgtggcgagcagtacggcatcgagacaggcgcagattgcttatggggcagatgaaaaaaaatgtttcatttcctatctcacggtggatattcagaaatatctgcagaagaaaacggagtatggtggaagagaacttttgtatgtgggcagtctgattcagagaaaaggactggatctgctgtttccggcacttgcacagaccagggaggatatctgccttacgatcgtaggtgaagggcaggagaaggaagcactgatggaacaggcaaaaaagcttgggatcacatcccgcatccgctttctgggatatgttgagggagaaccgctgcgggagctttaccataatgcagatgtatttatcctgccgaccagagaagattgctttggactggtgatcctggaagcaatgtgtgcgtctcttcctgtaatctcatcaaaatatgcggacggtgcgtttgacctggtacaggaaggagaaaacggctgtattatagacccggaagacacggctgcttttgcagcgaagattgatcagatttttgcggatgaaaagcggcttgcagagatgggacagaaaagctatgagttcgcgcacgcattttctttccaggaagtggcaaagggatgtattgatgcactgcattatgtaacaggaaaggcatgagcatgaagaagattttatttaacggacttggtaaccgcggatggattggtggtctgtactatctgaaaaatattatattcagctgtctgcagagtgaagagatcacaaagaaataccggattgtggtactgattgatccggaacatgcggatatttttacctgttttggaaaccgaattgatctgcgcatctatgacgggacgaacaaggtgaagctggcactttatgagatgaacctgatctggctgcacggcgtgaagtattgctacgcactggaactcaaccgcatcggcagtctgtttgcttccagagggatcttctggataccggatttccagcataagacgctgccggagttttttaagccggaggagctggcaagaaaagatgtcacggaccgcagaatgacggaactttccaatccgctcgtgcttagcagtgaggatgcaaagaatgatctggagcggttttatccggaacatcagtgtaaggtgcaggtcatacattttgtttcctacattgagccggaactgcgtgccatcacgccaaagctggagcacgaggtagcggaaaaattcgggctgcagagaaaatatatctatctgccgaaccagttctggaaacacaaaaatcatgtggtggcggtaaaagcgattgaactgttaaaaaagcaggggcttctggcagattatgattttgtatttacgggaaatcttaaggattaccgcaacccggaatatatcgatgaattaaagaagatcatggaggcacagccggtggcaggcagtatcaaactgcttggttttgtggagcgcacggagcagctttgcattatgaaaaatgctgcctttatcgtgcagccatctttatgtgagggatggggaacggtactggaagatgccaaggtactggataaggcagtgctgctgtcggatattccggtgcacagggagcagaaaaatgaaaagtgcgttttgtttgatccgcacgacccgaaggcactggcacagcttcttgtcgagacggcagaaaaggcagacatgccggagcatactgcatattttgcaggtgacatggagaagggaattgcaaacatgtaccgtgaagcggaagcatacgcaaggggactggaaaatatctttgtgtagaccaaagggctgaccggcatgaaatccccggaatggagataacgatgaaaaaaatggtgataaccggtgtcaacggatttattgggagacacgcaaaggaatattttgaaaaagaatatgagattacgggactggatcttgcagcaaattacagtggagagagagaaccggacgataccatgacctattatcagtgcaatatgtcacaggaatctgcagagatggcggcgatttttaccggtgtgcagccggatgtgatcctgcactgcgcgggaagtgccaatgtgggagcttcggttgtcaatccaatggcagatctggatggaaatctgcacagcctttatcagctgctgcttgccttgaaatcttttgagaagagaccggagattatattcctttccagtgccggtgtgtatggcaatcccagacagcttccggtgagggagtccgatgtagctgcaccgatgtcaccgtatggactgcacaagcatatgggagaggaattgtgtgagtattataaccgcattcatggttatcacatccgcagtatccgtattttttctgcttatggaaacggactgcgcaagcagctgttgtgggacatatatcagaagtatcagaatactgggagaattgaactgtttggaacgggggaggagacgagagattttattcatgtctcggatatcatgcgtgcaattgatctgatcttatcttacgatggaccggaggcggtcatcaatgtggcgaacggcgaagaagtatcgatccgggaactggcagagatttatgcagaaaagctgggcgcgccccaaaatatcgtatcttttaatggggcagtaaaagaaggtgatccgagaaactggagagcagatatttccctgttaagaaagcttggatatgagaagcagatggaactttccgatggaattgcggcttatgtggactgggcgaaggcgcaggattaggagcggtggatatgagtgagagaatgatggcgccggtcgtgttgtttacttataaccggccggagcatacgaaacatacgatcgaagcactggctgccaatgagctggcggagaagacagaactgtttgtattttccgatgcggcgaaaaaggaggcagatgcagcaaaagtacaggagatccgggagtatgtcggtacggtgcagggatttgcaaatgtatcgttgattgtgcggaaagagaactacgggcttgcccgaaacgtgatagagggtgtgacggagatcgtcaaccgctatggcagggtgatcgtcctggaggatgaccttgtgacaaaccgttatttcctgcgttttatgaacgatggactggatcgttatgagaaggaaaaacaggtgaccggagtcaccgggttttcctttttggatgatagaacagactatgacagcgaatcctatctctgcggtctgacagggacgagctggtcatgggcgacctgggcagacaggtggagttactttgatgcggaggcacttggctgggagaagttaaagacagatacggcataccgaagacggtttaattatgataatacctataatttttatcaacttttaaagatgcagaagcaggatgagaagaccaattcctgggcgatccgctggtattacagcacttttttactggacggactgatccttgctccgacaaaatcattggtcgggaatgacggctgggacggcagtggcgtacactgtggcggggaggctccgacagcagtgcatgccttaaagacggatcgggtcatcacacagttcccggatgtgattgcagagatgccacagatccgtaagcggctcaaaaaagaactgataaagatctcagagccgagccgggtaaagaggatctaccatgccgtattccggaaaaactatattggtcaggcatagagataaagaagaaaatgttggagacagagcttatgagagtattggcaatttttacctgttacaaccggagagaactcacaaagcagagcatggagctgctcgggcagaacaaaaatgtcacctttgattatgtgattgtcaatgacggcagcacggacggcacggatgagatgctggcggcgatgccgtatgagatcgatttaatcaacggcgacggcggactgttctggaaccgcggcatgtatgaggcgatcgagcacgccaaaaaggtgcatcccgattacgagtattatatgctgatgaacgacgacacgaagtttgtgccgggcattttcgacgagatgctcccgttgtttgcaccggataaggtcatggtcggggcgatgtgcggggatgacggcaggatgagctacggcggcatcaagtacgtcaagggcatcaagtacaaaaaatacggcccggaggcgcaggacatctgttttgacacgtttaacgcgaactgcgcgatcattccgcatgacattttcatgaaagtgtcgattgacccgttttatcagcacagtatcggtgattttgattacggactcgccatcagccggatgggatatgagatccgtattttcccgaagttcatcgggcagtgcaacgacggcagcctgaagggaacctggcaggacgagtcgctgccaaagatgcagcgcattaagctcaaggagagcagaaagggactgccgtttcgggactggttccatttcctgcacaagtattttggactcggaacggcaatcgtgcgttccatcaccccgtatgtccgcattatccttggcacgaagaccagatactcgggcgcataagaattcagggagacagtgccgatgagaacgatttgctatgtcatcttaaattacaaaacatacgaggaagccgccgcatgtgcagagtcgatcctttcgacgcagacctggaaaaacatgcatattgtcatcgtggacaacggttccggaaacgggagcgaggagtggcttgcggaacattttatcgatgaaaaacgggtgcgcgtgatcgcgtcgggagagaatctcggatttgccagagggaacaatctcggcatccgctatgcgagagagcactatgatccggatctgatcgtcgctgcaaacagtgacatcctgtttgaacagccggatttttgtgagcgcctgtttgagatctacgacagaaagccgtatgcgatactgggcgcggatgttgtggacgcgacccgcacgcagcactttaacccggtggcggagaagcgcagctataccttgaactatatgcgaaagcagatcttatcatcctggatccgggcgatgagctaccggatgtccaagctgttcttggggaagaagaacggaggcgatctgtcgcgtggcaccggagcgacccgcgaggtggacggcgaggcggtagcggcggacagcagagtcggcgaggagcgcgagggagtgctgctccacggatgctgccttgtgttttcaagagatttcttcaaagtgtatgatggcttctgggaaggcacctttttgtatgcggaggaggagattctctactatctggcggcaaagagcggactgcggatgctgtattcgccggaggtcacctgcattcataaagaggctgtgacgacaaggaagctgtacagcgatgtatgcgatgccaagattttttactatacacagatcaccaaatcgtaccgggcgtttctcggtctgatgaaagaatcgaaataggacagctatgagtgaggagaacaaggtaatcaaggccggcatcggctatacaatcggaaattatctgctgaagggactgagctttctaacagttcctctgttctcgcgtcttcttgatacctcggattatggtatttttaatacgtatctcgcttatcagggcattatgttcctgctggtggggattgcactgcataccagtttgaaaaatgcgaaataccggtacaaagaagaatttgaccggtataactccaactgtattctggtgatgctggtcagtctggctgtctggctttttcttgccaatctcacatatcctctgtatgcgggactgaccggtttttccagattcatcatcaatctgctgctgtttgacagttttggtacggcactgatccagttttttaatgtgtatgtcgggctggattaccgttatgattcgtttttaaagatctccgcattcaatgcactggggaacctgggaatgtccgtgatcctgattctgggatttttcaaggatgaccgtgcaaccggacgtatcatcggaaatgcattgccagtgatggtgatcgcggttgtgctgatctggtatttctggaaaaaaagaagacccaaatggaaccgggagcaggtcacttatgcagtaacatacagtctaccgttgatcccacatggcatttcacaggtgatcttatcccaatttgatcggatcatgataaagagtatgatcggaagtgcagaggcaggaatctacagttttgggtacaatattttttcaatcatcaatgtcacggcaaattcgctggacaatgtctggggaccgtggttttacgagcagatgcagcagaaaaagtatgaggagatccgaagacagagcagcaaatacgcatttggaatgctattgttttctgtaatggttatgctcggcacgccggaacttgtgatgctgcttggtgcaaaggcgtattgggatgcaaaatatacggtcataccgattgtcgtaggcggctattttatgttcctttatacactgccgtcaagtgtggagtattatcatgaaaagacgaaatatattgccatcggtaccgcgtgtgcggcggggatcaatatcctgctgaatctgtggtttatttcgcgttttggctatgttgcagccgcatacaccacacttgcgacctatgtgctgtattttgtatttcactatttcattgccacgcgggtacagggcttttgtatttttgatacgaaaaagatgatcctgtacggaatttccgccgtggcagccggggcactctccctgcttctaatggaacatggatggatccggtggggattactgcttttatgtgcggcgtggacatgcctatggctggaaaaacaatttcagattacggagaagatcagaaaacgattttggaaaaaatgacaggagaaagagtatgaagcggatagaaatgtcaatcgaggaaatacatgaggtaacacttgccatattgaagaaaatcgatgcgattgcggaagagatcggaatccggtattttatggcatatggatcgctgattggcgttgtacgtcacagggggtttattccgtgggatgatgatttggatatgatgatgattcgggaagattatgaaaaatttcttgcatactttgaagagcacgaacaggaacttgtgccatacaagatttttaacaaccgtaacaatgctggttatccacatatgattacccgggtgtgcaatgtagaatacccgatcgaagtggataatgagatctcgtgcggaatgggcgttttcgtggatatctatccaatcgatccgatgggaagcgacgaaaaagaatgggagcgagtaatgcactacagacagcagttgattgcgggtagttactatgcttcgcggattcggtttgaaaagccgggaaaaagttatcgttgcctggatcgatatctgctttaccgctatgcaaaaaaaaggggactggcttatttccttaacaaactggaatcctataaaaacagataccggtgggaggacagccggtatgccggatgtattgtgtgggaaccggaactgtttgaaaaagagtattttgaagaggtaaccagactgccgttctgcgatatgcaggtcatggtaccaaaggagtatgaccgtatgcttacgacatcatatggggattatatgcagcttccaccgaaggaagcacaaaaaccgcagcataactataccgcgtaccgcgtagaagcgtaaggaggagaaggatgcaggcaattattttagcagcaggaatgggaaagcggctcaaggagctgacacaggataatacaaaatgtatggtcaaagtggacgggatttctctgatcgagcgggctctcggacagctggaccggttaggactttctaagatcgtgatcgtggtgggctatgaagggcagaaactgatcgattatatcggtacacttgcggttcagacaccggtcgtgtatatcaacaatgagatctatgataagacgaacaatatctattctctggctcttgcaaaagagtatctgctaaaagaagatactctgcttctggaatcggatattatttttgaggaagccgttctgcgtgcgctggtcgatgatccaagagacacgctggcactggtggataagtatgaacgctggatggatggtacggtcgtgaaactggatgaagaagatcgcattatagaatttgtgcctggaaagaaatttaaattcagcgaacaggactcctactataagacagtcaatctgtataagtttagcagggaatttgcaagaaaccgttatgtgccattcctcgaagcataccagaaggcattgggaaataatgaatattatgaacaggttttgagtgtgatctcgattctggatgagccggtcataaaagcaaagcggctgcatggagaacggtggtatgagattgatgatgtgcaggatctggatattgcaacgacattgtttgcagagagtgaagatgagcgtgtctctttgctgggggcaaggtatggcggctactggagatatccgaaacttctggatttctgctatctggttaacccgtattttccgccacagaaactgaaagatgaactgcaggcgaattttgatgtacttctgacccagtatccatccggcatgcgtgtgaatgcgctgttggcggcaaaaaattttgctgtccgtccggaacacatcgtggtgggcaacggtgcggcagagctgatcaaagaggtaatggagcagatcggaggaaactgcggatttatccgtccgacttttgaggaatatccaaatcgttttcctacggagaggtcggttatctttgtgccgcagacggaagatttttcctatacggcggaggatgtgatcgcttactttacggcacacccgatctcctgtctggtcatgatcaacccggataatccgaccggaaattatctggatcacggggagcagatgaaactactgacgtggtgtgacagggagcagatcacgctgatctgggatgaatctttttcagattttgcggatgaaccggataatcagatgctcacagaggaactgctggaacagtatccaaagcttatcgtggtaaagagtatttcaaagtcctacggtgtaccgggactgcgtctgggtgtacttgcttccggaaatgagacgctgatcgcggatctgaaaaaacgggcagtgatctggaacatcaattcttttgccgagtattacatgcagattgcggagaaatataaaaaagattatgtggcggccatggagaagttcagagaggaacgtgcctggctggctggcgaactggaacagattgcgcatatgcgggtgtatccgacccaggcaaattatttcatggtcgagcttctggatggcagacgttccggcgatgtggtgcgtgagctgttagtccatgaacagatcctgttaaaggatcttaccggaaagataaagtgtggcgatagacagttccttcggatcgcgatcagaaaccgtgtggagaatgagagaatggtgagggcactggaaaacattttaaaataaagatgtttggccggtgtggagaataggtgaaaaatgattcaaagtattatatttattctggcaatgacttttataccatactttgttggatgcggatgtatattattagatcgcaaaacaggcgacatagatgtgcttgaaaaatggaattttggtatggtgctgatgcatgcgatatttgaaattgtagttctagctggcacctttacaaaaatgacattgaaaaacgttacagtgttctattttgcgattttgtccgcggcaatcatgatagtggggctgattgggaacagaacgaaaaaaaaagtgttttctgtagggaagattccttctttttctaaaaaagagatggcgttgcttctgatagtgttagtggggattctgtaccagattttgtttgtatgtctgggactacagagtgatgccgatgatgcatactatgtggggatggcgatgacttcttttcagacggataccatatcagtatatcatccttatctggggacacctgtaaaattaaagaccatggcaaactatgtcctgtcaccctatccgattttttgggctatgtggtcaaaagtgttaaaaattcatccggcaatcttgatgagaagtattcttccggctgtaaatatcgcatggtcatatgttgtatatagattgttagcgaaaaaaattttccttaccgaaagaaaaagaattattttcctgctgattgtagttctggcaaatctttttggcgcatattcggatcgtacaagcgccgtgttcttgcttcaacgtgtatggcagggaaaaggagcactggcggcgattttgattcctatgttgtggtatctattgatcagattgcgcaaagaaggggaaaacacatatgtttatgtagaattatttgtgacaattttagcagcatgtcttacatcctccatggctctttttctctgtcctgttttaatgggagcgtttggactggaatatttgatcagtgagcgaagatggagcgtggtaggcagactgatcttatgcacattgccatgcatagtactggcgattgcagaagtaattttattatatgtgctttagagaaggtgatgagtatgatacagcagggaatcgcatacatggcagaaatttttgaaatgtattttcaaaatgttggatatataatattggtgtgtgccgttattctattgttactgacacggtatagaaaaaaagaggtgacgcatttattgttcgtctgtgggattattctgattttatttttaaaccctgttgtgatttatctggtctgttcgttaaaaggagcggttacaggacgttatgtcagaatattctggcttttcccatttactattggaattgcatatgtgggtgcacagctgttggataaacgcaaattgtgggtgagagcaattatgattgcggcgattgtagtgatactctggggaacaggtggaccggttctgaaaaagtatatagctccttctaattattataaaatagattcggagattatcgagattgcagataagatcgagacatatgaggatgcaccatatgcgctggcaacagtttatgtaagcacaaatataagacagtatgatgcgaatataaggcttgtttttggacgggaaaatataaatcctgaggttcaggatttatatgatatgctatacagcacagcagcaggatatttttcctatgatgagctatattacattggtatacgttctgcagaaataggagtgaatacgattgtacttgcaaaacaccaggtgcaatgtactgcattggaaacacttgggtatgaacgtgtggatgagacagaggaatattacatttttgataagagacaaatgtaaaacgtgcaaagttgcgacagcatggacattatgatataatgaactttaacgagtttatattagaagttcctgtggaacttcagatgcgcagaaggcagcgcagtcagtgcacagaaacaaataacagatgttactcatcaatgaaaaaggaaataatggaatgaatctgaaggaacaatataagcatttactgaattatggcgcaaaccttatcacacttctggtggaaggcttgtgttttggctacatctggtacattgtttacgaggagcagtttggcttctggcgccgtggaaactgggcggttgtcggactgtatgtgctggtaatcttcttttttacgaaggtatttggtgggtacaatatcggctatatgcggatgacggatattgcattgtctcatattttatccattttactgagcgggatcgtcggatatctggaactctgcctgatctgccgtgattatgtagagccggcacctatgcttgttgtcatggcagttgagacaggcttcattctgccgtggatttacatcataagaaaactttatactaagctgtatccgccgcggcagatgctcgtgatctatgggcattatgcgccggacgagctgatcttgaagatcaatacgcgccgcgacaagtacaatatctgcggatcggtcagctacgagatcggtcatgagaagctttacccgatgatccgcaaatacaatgcggtggtgctctgcgatctgccggcacaggcgagaaaccagatcatgaagttctgttaccaggagtcgatccggacatatgtgacaccgaagatctcagacatcattttccgcggggcggacgacatccatctgtttgacacgccgctgctgttatcgcgcaatcagggattgtcgattgatcagcgcatcatcaagaggacctgtgatattgtgctgtcactgatcggtattgtgatcgcatcgccgttcatgttaatcattgcgttggcggttaagctgtatgatggcggtccagttctgtataagcaggaacggctgacccgtgatgggagaccgtttatgatctataagttccgcagcatgagtatggattccgagaagagcggcgccagacttgcggcaaagggagataagcgtgtgaccccggtgggaagggtgatccgcaacatccattttgatgagctgccgcagctgtttaatatcttaaagggcgatatgtcgatggtgggaccaagaccggagcgtcaagtgatcgcggatcagtatgctgaggagattccggagtttgtgttgcgcaccaaggtgaaagcgggactgaccggatacgcgcaggtatatggaaagtataatacgacaccgtacgataaattaaaattcgatatcacttatattgaaaattattctctgtggctcgatgttaagatcatgctgttgacgtttaagattctgtttcagaaagagaatacagaaggcgtggatgagacacagaagacggccttaaaaggataagctggaacagggagcagggaatatggcgttttcagtattaatgtcagtatataaaaaggaaagaccggaatatttgcgtgaggcagtgaaaagtgtatttgcgcagtcgcttgtcccggatgaagtggtgttgatggaggacggaccgctgacggaggaactctatcagatgatcgcaacgcttgaaaaacggtatcccgcgctcagggtttgtccactcagagaaaatgtacagcttggacgcgcacttgcaaagggcgtggaaatgtgcacaaatgaattgatcgcaagaatggatacggatgatcttgccatgccggatcgattcctgcatcagtatgtctatatggaagcacacccatctgtgatggcctgcggcggctggatgcaggagttcaatgatacaggtacttatcacaggcagaagcagatgccgcagcacaatgacgagataagaaagtatggaaagtaccgcaatccggtgaatcatatgactgtcatgtttcgcaagagcgcagtgcttcgggcaggaaattatcgtcacgttccgctactcgaggattatgatctctggacgcgcatgatggtacagggaatggagttttataatcttccggaggtgctggtttgcatgcgcaacaacgatggcgtgtatgaccggcgtggcggttttaggtatttccgccggtatgcggcattccgaaagagccagaagcagatgcactggctgaatggaagggaatatgtcgtcgcgttgattcttacgatggggatgacattgcagccggaacgaatgcggaagtttgtatatcagaaaatacttcggaaataagagtgagggttatggagaagatattaagtattgtcattccggcatataatgtcgaaaaatatttggaaaagtgtctggcttcttttgaaatacaagcgattttagacagaatagaagtattggtaatcaacgatggttccaaggatcatacggcagagattgcacagcggtattgtgaaaagtatccagagacatattttctttataataaggaaaacggtggtcatggatcaggtatcaattatggaattcgttatgccacaggaaaatattttaaagtggtggacggggacgactggctgaatacagaagagctggaagcgtttgtgaagctgttggaggagacagatacagatattgtggcggcgggttttttgtgtattcaggatgagacggacaccgtcctgcaggagaagcattgtacgccttgcagagagcagtatggacacattgtggatcttacaaagggtgaggtggtggatgtgataaaaatgcatgcactgaccatccggtcggcgatattgaaacagaatcacatccagattgacgagcattgttattatgtggactgtgaatatattacttacccgattccgtttgcaagaacagtttatttttatccaaagttcctgtacatgtatcgacttggcagaaatggacagagtatggatatccgaagtatgcagaagaatcgtatgcagcatcagaaggttttggacagcctgttgaagttttatgcgggactgcatggactgtctgacggaagtatgagatatattgagcgctgtattgcacaggttgtggaaaatcagtttcagatttatatcagtatggggtgtgaatctggaattaagaaagaattaagaaactgggatcaagggttgaaaaagaggtatcccaggatttacagtgccacaaggaaaaagagcattaccatgctccggagaacgaattatacgatgctgcccattggaacaattgtatacaaaattgtacgatctagaagatgacagtgacttgacaaatatacatttttccaatattgtaagatagtataggtttttgcagattactttagaagtgagtagaatgtcgtaagtgaaaggagatatataatgaaagttgttttattagcaggagggtttggaacaagaatctcagaagaatcacatttaaagccgaagccaatgatagaaattggcggacagccgattctctggcatattatgaaggagtactcatcgtacggattcaatgagtttgtgatctgtgcagggtacaagcagcaggttatcaaggagtattttgcaaattactatctgcatcgttcggatattacatttgactttacggcgcagaacgagatggtggtacacaataatgtggcggagccgtggaaagtatctattgttgacaccggactcaatacaatgacaggtggtcgaattaagcgtgtgcgcgattatattggcaatgatacatttatgcttacttatggagacggcgtctgcgacatcaatatcaaggagttatatgatttccacaagaagagtggaaaactggcgactatgacagccattcagccgggagggcgtttcggaacacttgatatcgatgaaagcaatacgatcgagcgtttctctgaaaagagaaaagaagatggcggatggattaatggcggctatatggtaattgaacctcaggtcattgattatattgatggggatcagactgtttttgaaagagagccgctggagcgtctggcagcagaggggcagttacaggcatataagcatgatggtttctggcagtgcatggatacgctgagagataagaatttactggaagagttattggagcagaataaagcaccgtggaaaatatgggagaactaagatggatttaagtttttataaaggaaaaacagttttagtaacaggacatacgggatttaaaggaacttggatgtgcaaggtacttatgatgcggggagccaatgtgatcggatatgcattggaagcaccgacacagccaagtctgttcgatatgacgcatatggagaaggggatgacgtcggtaataggtgatattcgtgatctggcacatcttaatcaggtgtttgatgaatatcagccggaaatcgtaatccatatggcagcacagccgatcgtaagagaaagctatgcaaatccggtatatacgtatgaagcaaatgttatgggaactgtaaatattatggaggcagtccgcttacatgaatgtgtaaagtcatttgtcaacgttacaacggacaaggtatataaaaataatgaatgggagtggggatatcgcgagaatgatgtcctcgatggatatgatccgtactctaattcaaaatcctgttcggagctggttacaagttcttacaagaaatctttctttggagacagaactgtcgcaatttcgacgtgtcgtgcgggtaatgtaatcggaggaggtgattttgcaaaggatagaattattccggattgtgtgagagcgcaggaagccggaaaggaaattatcgtccgtaatccgtattcaaccagaccgtaccagcatgtgctggagccggtatgcacgtatttgaagctggcagaacttcaatatctggataaagacagatatgaaggcagctacaatgttggaccggatgactgcgattgcgtaaccacaggagaactggtagatctgttttgcaaatattggggaccagaggctacatggaaagatgtatcagaagcgaatgcaccgcatgaggccggatttttgaaattggattgctccagaattaagagagtgatgcagtggaaaccgaagtggcatattcaggatgcagttgcaaatagtgtacagtggagcaaggtctatctggcgaagggtgatctggttgccgagatggaaaaagagattaccgattatttgaaatagattttaggaggcatttcatgacaaaggttattgtatcaggtgcaaatggatttgtaggtggtgctcttaccagagagttgattgcaaatggaataaaagtagttgcattagatatggaagggcacaataataatctgcctgagagtgatctggttgagttttacccgttttcgcttgacaatgcagaggagctgcaggagagattggcagaccgggattttgatacgttttatcattttgcatgggctggatcggcaggaccggccagagcggatacggcgcttcagttaaaaaatgcacagtggacagtagattgtctgcgccttgcaaagaagctgggatgtacaaggtttgtgaatgccggaagcattatggaacttgagacaatcaaggcggtatttaatccgggaaataagccgggattgggctatatttatggaagcggaaaactggtggcacatacaatgtgcaagtctgtggcggctgatataggtattgatctggtgtgggcaatgattactaacgcatatggtgtaggcgagagaagtccaagaatggtcaatactacgatccagaaatgtattcggggagaagcacctcagtttacagccggaacgcagaattatgactttgtctatattgatgatgtggcaagagcatttcggctcattggtgaaaatggaaagccgttcaatgaatatctgatcggttcatccaatgcaaaaccgctaaaagaatttttgctggaaatgaaagctgcaattgctccggaacttgattttatatttggagatattccgtttacaggcgtgaatcagccgttagaggactttgactgttctaagacagagcaggataccggttttagagcagagatcagctttggagaagggtgtcgccggacacgtgactggtggcttgagatcgcgaaggaggagagtaaataaatgatccagaagtttgaatttgaagagacagagatcaagggacttatcaaagtcactccgttcaatgcagatgatatcagaggctgctttacaaaggactattccaaggaagtatttgaggcaaacgggatacaccatgatcttgcagaggtgttttatacaacctcccataagggagtaatccgggcattacattttcagcgcgaaaaacagcagccaaagctggttcgctgcatatatggtcacgtttatgacgtggttgttgaccttagaaaggatagccccacatttaaaaaatggcttggctttgatctgatcggggagcagcataatgagatactggtaccggcaggatgcgcacatggataccttgtgttggaaaagtcgatcgtaagctacaaatgtggagaaaagttttacggcgaatatgacgatggcattatgtggaatgatccggacattgctgtagagtggccattggaaaaagtgggtggattaggaaatgtaattttggcagataaagacaaaaatctgcagacatttgaacagttcatgaatacgtatggaggattctaaatagagaaagattaccgcaatcaatcatggaatggattattgcggtaattttgttgtgagaagatggaagaaaaattgtatccaatcaggcagcacgaagttgcgattacaatggcatgcagcgacagctataagaatataatgggcgttttgctgcaatcaatcattacaaatgcagatgcacaagagaattatgatattgtaattttggaatacggaatcagtaaaagcgaccagagcagaatcagccggttctatcagcgtgaaaatatttcggtaagattttatagtgtcagagagcagatagagggcaaggatctgtatgttcacggatatttatctgtgatgacctatgccagattgctgattccgcaaatatttgaaaattttgaacgtgtagtgtatctggattgtgatatggtatgcaatagtgatattgcacagttgtttcatgcagatatgcaggataagccccttggagccgtggcagatacggtattaaatatggaagcctggcataatccaaacagcgaggagacaaaacaatatctgaaagagaccgttggtattacaaccgaggggcgttactttaacggtggagtgattctgtttgatatagacaggttacgggaagatggagaaaaactgttggcgtgcgcccgggaaaggcagtggcgctgggcagatcaggatgtattgaatcatatatataaggagcgcgtgttttactttgacctacagtggaatgtgattgtgatatcaaatctaaaacaacgcaagcggtatctgagcgacagtaagttatacccggattatgaaagggcattggaagaaccatgtattattcattatgccggagagatgctaccctgttatcgaagaaatgtaccactggggtacaaatttttgaaatatgcagaaggttctctttatgcagagcagtttcagagaaaaaagtttaaacgatcagtcgggaaaagggttctgctggatcagatcgcacgtgttattccatatgacagtaagctaagaaaacagattaagaaaataagtgtaggaaggtaagagatggagttattaataagacgaattaacgggttatatgcatataaagaccttgtaaagcagttggttacaaaagatatcaaactgaaatatcgcagaagttttctcggatatttctggagcatactgaatccattgttgattatggcggttatggtagttgtcttttcacagattttccggtttgaaatagatcattatccggtttatctgatcatcgggcagacgctgtttaactttatgagtgaatccacgggacaggcgatttattccatactggggaatgcgccattgctaaaaaaggtgtatgtaccaaaatatatttttacgctctccaaggtgacaagttcgctggtgaatcttttgttctctcttggagcaatgttgattgtttttatagcttcaagaatacagttttcaatttatatgctttttattcctgttatattgattgaattatatgtattctgcctaggacttggaatgtttctggcacaggctgctgtatttttcagggatatccagtatatctataatgtgtttatcacggtatggatgtatcttacaccgattttttatccgatatcaattctgccggattatgttaaaaatgtaattgtgaacataaacccgctttatttttatattgatcagtttagaacagtagtgctggaacagcagctcccaatgatgcacagtgtggcaggcggctgtattgcagcaatcattgcattaattttaggaatctggtcatttttgaagacgcaggacaaatttattctgtatatttagtggaggaagtatggatagtgaatatattatcgaggtaaatgatgctacagtcaggtttaatatggcatcagagaaaattgataatcttaaggaatacgtcattaaatttattaagagagaattgatgttccaggagtttttggcgcttaaggatattaatctgaaaattaaacccggagaggcctggggattggttggaacaaacggttctggaaagtcaacattactgaagctcatcagcggtattttgaaaccatataagggagaagtgattatccgtggttccatagcgcctctgattgaattgggagctggatttgatgcagagcttacagcaagagaaaacgtattcctcaacggtacgttgctgggacattcagaagctttcatgaaggaacatttcaatgaaattattgatttcgcagagttgtgggattttctggatatgccgattaaaaattattcatccggtatggcagcacgtctaggatttgcagttgcgacgatgacgagaccggatattttgattgtagatgaagtccttgcagtaggtgactatgagtttcaggaaaaatgtaaaatgcgaatgaaaagtatgctggaacaaggaactacgttactctatgtctcccatacaatgggatcggttacttcattgtgtgatcatgcaatttggattgataagggaaaagcggtcatgcagggggatgtcaacacagtatgtaaagcatatatgaataaataggagaacatgaagatgtcagagaacaaggtagtaatagcaggtatcgatgaaggcaaggatttttatcaggttcagaataatgaatttgtgtatgagaatgcaaaaaaggataagacagtataccaggtcttgaaagaggatctgtatcgtgagattggcacacagcttgccatcaaaccggatggcgattatataggaatgatgcagtatcggaggttttttacccaacaggcagaatatgataagccatatattggagaaacttacttaaatgacaaaacggctagaaaatatgggctcaacactttttccatttcagatgtaatgaaaagcgcacagattatatatccagaaatggtggttaccagagcatatgatgcaagaaatgtgcgtgagtattttgcaaaatttgataaaaagcatgatgcggaacattttgttgtgtttgagaatgcactgaaagagaaatatccagaatactccagtgagtttgaaagttatatgaaatccggaaaaatggttttgtgtaatatgtttcttatgaaacgggagttgtttgtgacatataataagatggtagaaagtgtattggcagtattggatgaaaagcttgatatgcggtatgcatcttatgagcagacaaaggagtacagtatgtttactgcggtcatgctggcgacattctgcagataccaggaaaaacagggagtgaccgttagagaattacctgtagttgagtttgaagatgtaactgtgaagacagaactgaagccggcatttgagcacaataacgtagcgatggtacttgcatccagtgatttttatacgatttacctgtcagcaatgcttgaatcgattgtggaaaatgcttctgatgaaaataattatgatattaatgttttggaaagcggcattagaccagataataaagaagcattaaagctgattgccgaagggcatgagaatgtatcgatacgtttctacaatgtaaaagaaaaaatggcaaatattcatctgaaggcgacaggccatatcagtgtagaaacctactataggttgctgattcctgagatttttatcaattatgataaagtgctgtttttggacagtgatatgacggtacatgcggatgtggcagaactgtttcacatggatgtgaccgggtatatggtggcagcagcacatgatcaatgctgcgcagcatttttaaatggaagtgataagtcgtttgcgaaatattgtcgtgaatcactaaaattgaaaaatgtacatgattattttcaggcaggcgttatgctgttgaatctgacaagatttcgtgaaaaatatacacagaaagaaatctttgagattgcaacaaaacgtcagtatcgctatgtagaccaggatatcatgaacgtgttatgtcagggtgaggtaaagcatctggatcttgagtgggattgtttcccggattttggaccatatgaatatgaatttatgccatactatttgcagaaacagtatgcggtagcaagaaagaatccaaagatctgccatcatacaggcccgaataaaccatggagtgagttgtttgcagataccatgcagacggagcatttttggagaagagcgagaaagtcgccgttgtatgagcagattctgttcagaacaatgatgacagccagtggggcgttttggtcaggtgagatcgtgggaaagaagaagtccacaaagataaaaaataagattaaatacggatttattgtgccggcggccaatggaatgtttccgcgtggaacaaagcgtagaaagagcgcaattaaattttattatggcattagacgaaaagagattccgacatgggagctggatgactaaaaggtgatgatattatggggagaagaagagtgtttttcaaaagaggaaagaaaaagcaggatactgtgcaggaattaaagccggtatataagttatctggacaaaataacaaaatttttattatagaaaacggcacggagagagaaattacatatagtgaaaaagttgcaggtatcgagattaaaatacagggaaataataaccgggtgtatttggaacttccgataaaagcggtgggaagtacgattactatcgataacagtaatgcagaggtccggattggaagcactttcctattgaataatgttagaattatatgcaatgatggaaatgagcagcgggtttggatcggagcaggaactaccatgcacaatgtggggatactggcgacggaaaatgcggatatcagaatcggagcgggatgtatgttttctgcaagagtatatatctacgggtctgacggacatgcgatgtttgatgtgaataccggagaatgtattaacggaagaaaacatgcgactgtgatcggtgagagatgctggatttcatcagattccatcattttaaagaatgctgtaattccggacaacagtattgtggcggccgcaagtgtcgtgacgggtaattttgagggagagtcgaatgtctgtctgggaggaaatccggcaaagatcataaggcggaatgtggactggtcgtatgagagtccatcggaacgtttcgcaaggatggcctgtgaggagaaaaaattgacattgagttcggaagagttagaatggagtgttggacaggttggaagattaagcgcatatttaaatgaatgcaggattgccaattcgcaggtggaatggagaagcgaagatcggagcatatgtaaggtaagtgcagcaggagaggtttgtggaaccggcaagggagagaccagtattgttgcagcgtatgcaggtgcgcaggcgatatgtaaagtggaagtgcgttaatgcaatggaacggcaacagatatgttgctgtaacatgtaataagaatgaggatcggaaaatcaatgataaaaaatgttgtagaagataaaaaatgtacaggatgttattgttgtaaggatgcatgtccggccggagcaatagagttatctgagaatgaggatggatttcgggaagccggtgtaaatgataccatatgtattcaatgcgggaagtgtttagaagtttgccctgtcgcccatgatgagaatcgaaaagcatatgacgtttcgtcatatgcttttcgagcatgcgatgaagttcggaaaacagcttcatcaggcggcgtggttccggtggcggcatctgttatcctgcagaaacagggagttgtctgtggagtacagcttacacccgatctgaaagcacagtacatagttatagatcaagtcgaagatatagcaaaaataaacgggtcaaagtatatacaggcagatgcgaccggaatttaccgtaagataaaaacgcttttactggaaggaaagacggtcttatttacaggattgccatgtcagaccgcgggattatataactacctgaaaggatgtgaccagagcagattatatacaatagatatgctgtgtcatggtacaccttcagataaagtatttcgggaatggctttctggtgtatcggaaggaaggcatgccaaatatattaattttcgtgtaaaagacggtgactggaattgtaataccgtgtgtattgaatatgaggacggttctgcttaccgggcagatgttaccgatgattggtttgaaaaactatttcattataatatgtccttaagaaaatcctgttatcattgtaaatttgcggagtttccgcgcaggggagatctgtctacgggagattttcatggaatagaagattgccaggatattgaggatgatcataaaggaaccagcgttatattcgtaaatagtgataaagggcagatgcttttgaatgagatgaaaaaagagaatgtctggatgaaagagatttcggtggaggattccaaaaagaaccggatttgtgcagatatagaagaacatccatacagagatcgtttttttcgtttactcagagaagagaaatatgactttgcgaaccttgcgaaacgtgtactggaacataaattcgatataggaatcgtgggaattccaacagtagaaaaccatggttcaaacttgtcctattatggactttaccggacattgcagcatatgggatatgatgtatttatgatggaacgaccaaaatcagcctggtgggctccgcatgaaacaccggttatattcagggaaaatccgtatgacagcggagatctgtgtgaattgtttgagagcagactgcaactgcagaaggcgaatgactacgcggatacatttattcttggctcggatcagctgtggtatgaaggactatatgcatgctttgataaattttgttttatggactatattcatgaaaacaaaaataaaatcacgtacgcagcatcatttggaaggagcgagtatcatgcgaccagggaggagaaggcggaggccgcattttatatacagggaatcgatcatatatctgtgcgggaggaaagtgcggtagaactgtgtcgacaggagtggaaccgggaggcagtggttgttctggatccggtatttttgtgcccgacagaagaatatgaaaagcttgcggataaggggaagaagaccgcatataatcaatatattgcaacttatattttagacccctcgccggaaaagcagcagattattgaaaaagcagcacagaaattagaattaccggtaataaacatgacggatgtcgtgaatgtggaagaaaaatgtgcacagtgggatcttgatatggaaagtgatgtttccaatgaagattggctgcgtagaatacgggagtgcacattttttattacggattcttttcacggaacctgttttgcccttatttttgaaaagcagtttctggcaatcggaaatgcatatcgtggattagaccgttttacggaaattcttggtaaagttggtcttaaagatcatcttgtatccgcggaggagatcgatacgctggaagagaagctggggcagagcattgcgtatgataaagtacggagtgcgttgcagagagaaaaagaaaaatcgggagaatggctcaaaaatgcaatctgtgccggaaaagagaaccggctttccggttatgatattattcagaaggaaagaatgaaagaggaagaacagcttttctggcagaaaaatatgattgatgcacatggaaatgtacttggagcacatgatacaagactggcagtatatgacggtgcattgggggaattgcagaaagatgccgagcagagaagaattctgtttgagatacagcagaaacagatgcaggaatttcaagatgcaatcctccagttaagacagcagaaggaagaaatgaattccgttctgtgtgagttgcagggaaagaatcaggctctggaggaagaaatcaggcaaataaaagagaaattcccgttgaaacgctgggcaaagagattcatacaacggttcagaagaagataaacaaaggagaaaacgatgattcagataggcagaccatacatagaacaagcaggtaaaaattttcggctgacagcagatgtcgtgatggatcaggaaacaaaaaagtggtggtttgaagtacccgctgaatataaacagtatctgtgtaccgagagaagcgatgcctttctcatagggatacttccactcgcaatgcgcttcggcgaagatatatcgttggatgccccggttacagaggagcttttatttaatatagagacagaactaatcccgtcattggtgaacagcagcaaaaatttgtatgcaagcaggatattcgcagagacagaaacagaaattatcaatgagggcgcctggggtgtcggaacgggaaattcaatgggagtagactcttttcatgcaatagaaatgtcattgcataatcattgtaagagttatcatttaacccatttatgtcattataatgtaggagcgtttaacgatacatacagcacggcaggagaggatgaggttcgtgaaatatgccttagaaatgcaaaacaggttgcagaggagtatggtctgccgatgttgatatcaaactcgaactatgaggagattgtggatatcaaccatctgtttgtaaatacctatgcgaatttatatgcggtatattgtctccaaaaattgtggaagacctattatctggcatcctctgagtttggatttcacagatttcaactggaagataatgatatgtacgacagtgcacattatgatctgttgaccgtgaattgtctgtctacgcgggggctgaaaatttattctgagggcggagaacggaatcgccttgagaaaataagagatattgtagattcggaggttgcacagagacatcttcatgtatgtgtgagagaagcttataactgcggtgtctgccataaatgtaagaaaacattggtggcgattgatgcgctggataagctcgagaactttagcaaagtatttgatctgaaggcatatgcagtgcacagagagaaatatctggaagaaatctgtgagttacacatccagaatccactagattataatgaaccaagttttcagctgttaaaacaccgcatgccgcaggaaatatgccggaagtatgcagatatccttgaccttggaaaacagcaatatgagcagagaggggtatgcgagattgacggcgtgctcagttatgtgaatgccgatggatataaagcggaagaaggctggatcatagaaggcagaaagcggtattattgcgttggagatggaaaactggtcgttggaaatttccatcagatcgatatttcctggtacttttttgatgtggatggaacgatgcaaagaggcttaaagcagattggaaatgacttttactattttggaaaagacggatcactgcggagaggtttacagcagattaacggcgaaatgtggcatttcgatgagactggaagaggaagtgacgcaggatggatacaggttggcagcagaaaatactattgctttgggcagggaagattggcaaccggtacggtctgcattgatggatcgaattttgagtttgaaacaacgggtgtcatgaaatagcacttaagggagaacgttatgaagttcatgtttgcatttggtctggcaagtattatgctctgtataggaacgttattgcgggcaaaggtgaaggtattccagaaaatgctggtgccctccagtgtgatagcgggaattctgggtttctttttcctgaatgtgctgtcactgcaggatattgactgtggagcagattctgcgatgtatacggaaattgttaatcaattatttacaatttcgtttatttctattacgcttacatcagcgcccggacaaaataaaaatacggcaaaaaatattatgagtggtgtatgggggatgggaattgtctggtgtattctgtacgcactacaggcgctgtccggcatgctgattgctaccgtgctggggaagtacaacggaatggataatgcttatggaaccctcgtagcatttgcgtttgcccagggaccgggccaatctgcggcgtttggaaaaatatacgaaggatatgggtatcagaatgcagcaatgatcgctgttacatttgctgtaatcggattctgcatggccttcctggtgggaattccgttcgcaaaaaagggaatcagacagggctatgcttcaaactgcggcagaattgagccggcggttttgcgcgggtattacagaaaagaagaacagacagagtatatggtaaaggatacgacctgtaacagtaatatagagacattgacatttcattttgcggtcataggagtgtgttacatgcttgcgctgggaatttcaaagatcttttcctgcattcctggttttttcggcagttccatgagcggtctgatgtttatgaatggtatgttcgcagcatatatcgtaaaatggatcatgaaaaaaactggagtggactttttgaaggaaagcacactgcaaaacaaaattacaggctggacggcagattatctggtggtgtgttcttttatggcagtagaagtaaaggtacttgggaaatggatgatgccgattattgtgatcagtattgccattacggttctgacggcagcggtatgctttttctttggaaaaagatttggcggaagcaatgattttgagcgtactttaggcttatacggaacatgcacaggaaccgtggcaagtggtatatcattagtcagaattgttgatcctgaatttaaaacaaccacagcactggagctgggaatgatgaatcttgttatgctgctaagtacaccggtgtatattttactgctgggaatggcatcgggcgaagtgggaaaaacagtgctggcagtgtctttgagtgctcttgtggtaatttatgtggtattgttgagggtatttaaggcgtttggaaaaaggacttattaaaacatgaaaacattgtattatggaggtccgattcttacgatggagaatcgggaagacaaaccggaagcggttctggttcagaatggcgtaattaaaaaagtgggacatttggatgaacttagaaatatagccggaaagagagtaaaagaatatgatctgcgtgggaaatgtcttatgccggcatttattgatgcacacagtcatattacgatggcgggacaggtgtctgtgctggctgatctcacggaatgcatgaactataatgacatcgttcaaaaattgaaaagttatataaaagatcatcatgttaccgcaaaacaggcggtgctggggtttggttatgaccataatacattgtgtgaggaaaaacatccgacaagacagatactggatatggtatcgcaggatataccgattatgatactgcatatatcgggacatatggcgtgtgtaaacagcaaagtattgcagatgtgtggcattacccgggatatggatgatccagagggaggcgtgattggaagagaagatggcgggagagagccgaacggctatctggaagaggcggcgatggctcttgtacagagccgaatcggcaaacttgtgaagataagtatccgaaaaatgattcgtggaatgcaggaagtatatattcaaaatggaattaccacgatacaggatggagcgtctacatcgcagaatatagcacttttaaagagcatggcagcgatgcatttgttaaaaacggatgtggtagcgtacccattaatgacggcaaacggttgtgaggtacttcataaaaacaggaaatatgtaggagcatatcacaacagattaaagataggaggatataaactggtgctggatggctctccgcagggacggtcggcatggatgacagagccgtatgagggagaaccaaaaggatattgtgcatatccatggctaaaggatgagcaggtaaatgaatatgtaaaaaaggcagtcgatgaaggacaccagattttagctcactgtaatggagatgcggccggggatcagtttatcactgcctatgaaaaggcagttgcaaacgaccagaccgggcgggacatgcgtcctgtaatgatacactgccagactgccaggacggatcagctggaccggatgaaagaactgggaatgattccctcaatttttgtcggacatgttttttactggggagatattcatataaaaaattttgggcagaagagaggaatgcgtatcagtccggtgaaagatgcattgagccgtggattgaacgtaacgtttcatcaggatacaccggttacaaaacccaatatgatgcattctgtatggtgcgcagtgaaacggatcagtaagaatggcacaatcgtgggagaagatcagaagattgatgtatacgatgctctgaaatgtattacgataaatgcagcgtaccagtattttgaggaagagaaaaaaggaagtataagggaaggaaagatggcagaccttgtagttcttgagaagaatccgcttgaagttgatcagatgaaaatccgggagatcagagtgattgaaacgataaaagagggtaaaacaatctataaagcacaatagcggaaaaaagaggatagggaggacataatgagaaaaagattattagcaggtatattggcagtcacaatgatggttagtgccgtgatctgccctaatgatcaggtgctcgtaatggcagcagaaaccgggactgagcaagtgaatgttgagtccaccgaggtaaatcaggaggaaacacaggtgcctgataaaacggaggatactataccggaagagacagaaaaaaatgtggatgattcgcaaaatacggaatcatccgaaacgacagaaccagctgaagggacggagacaacggaaacagtcgaggaaaccgaggcaacggaaacagtcggggaaaccgaggcaacggaagtagtcgaggaaatagaagagaccgaggaaaccgaggaaacagaggaagcgagatactacatacagtatttggtaatggaatctgataagatttctctgaatgagacacaaaaagttgtacttggaattgactgtgaaaaagaaatcgattatgcaagtctcgagtatcataatcagcagacgggagaagtgctttcacaggattctaaaggggtaacagatggagcaatcttatttgaaattgcatttcagaacgcctcacaggaaggctcctatcagcttgatgcggtaacgttcgtagttaacggcaaaaaatataccgagaatatcaaggacgctggaattgatgctgtatttggtatggaacaggatgtcgatgtaagcccggatgcgattattgaggatgaaagttcacaggatggcagcgttctggatgatgcagatattgtccagatcgatgaagatggaaatgtaatatcgcagaattccattgaggatgcacttgacagcgtcattgaggaagacgatggaatagcattgtttagtgcccgcagggacattgtcgtcgtattggacccgggacatgacaacagtcatactggagcgcagggaaatggattaagagaagaaaccattaacttgaaaattgctgcatattgtaaacaggaattggaggagtacagtggagtaaaagtatatcttacccgacctacagatggaagctgcccatatcctggaaccacttcaggggtctgcaatgaagatcgtgtaaaatatgcgtcaagcgtaggcgctgatatttatgttagtctacataataactcttctacaaatacatctgcacatggtgcaatggtcttttacccaaacaccaattataattcaggcgcgtcacagaccggaaagggattggcgcagttaatagagaaccatctggttgcattgggattatataatcgtggtattacgatcaaggatgcgcagcaggataagtatccggacggaacagcagctgattattacggagttatccggaattgtaaactggcaggtattccggcaatcattgtcgaacatgcatttgtaagcaacagtaatgatgcaggaaattatttaaatacagatgcaaaattacagaaattaggagtggcggatgcaacggcaattgccgagtattatgggttaagtaaaggggttaatgtcacatcagacagtataaagattaccaacctgaataatgcggccggcacggcaacactcagtgtcaatggggtaagtccggatgataaagtgcgtgcggtgtcatttgccgtatggtcaaaggcagaccagagtgatatatactggtatcacgcaaccaaagtgggagttggaggatacagttcgaactttcagataagcaatcacaaatataatcaaggtacttattatgtagagggatatgcggaagatatttatggtatctctcatttattgggacgtgcaagctgttcatttagcgtgaccggaggaagcgtatcggtacgccctgtcacagccggtcaatatacattaacacttacaggcgtaaccgtaccgggaggaacggcaggagtttcttttgcggtatggggagatgtgaatggtcagaacgatttaagatggtacaatgcgacaaaaaacagtgatggatcctggagcacaatccttccgattgcgaaccatggggaactgggggtctatcacgtgtgggcatatgcagtcaatatgggactcaccagtacatgtgcggtacagacagcgtttgaacatcaggaaacggcttctgttcaaagtattgccataaaaaatatgaacagtacagcaggaacttttgacattttcgtaaacggcgtgcaggcatcctgtggggtaagcaaagtgcagattccggtatggagtgaaagtgatcagagtgatatttactggtatacggcgacaaagcagagtgacggcagttatgcggcacaggtaaacttaaagaatcatggatacaactattcaacttataatattcatgtttatgtgacatccagcacacaggtaaaaatggtagcgggagttaccactacagaggtatatccgcctgcagttaatttaaaaacagaacttgcagcggatgagctgacatgtaatttgacggcaagcaatgtaaaattatctggaggcgtgcagaaagtttactttgctgtctggagcgataatggcggacaggatgatctggtgtggtatgaagcacaggaatctggaggagtatggaaaagaaacatttccattgcagatcataaaacagatggaacgtatgaggttcatctttatgcggaaaacagcagtgggaaaagaatttttatgggaaataccacatttgatgtttcttccatcagtgtccagaaaattcaggcaaaaaatgtagatgcggtcaatggaagttttgatgttgtggtatccggatttgtttcaccatccggggttcacacggtacaggttccggtatggagtaagagtgaccagagtgatattcactggtataccgcggcaaagcaggcagatggaacttacatagcgcatgtggagatttcaaaccatgattataactatggtaagtatactattcatacctatgtgacggctggaaacggagtatataagtttacaggatcaacaagtacgtccatttatccactgcaggcaacagtcagtgcagtattgtcatccgatgaaaaaacatgcagcctgtcagcaagcggagtgcagatgccgggaggcgtgcagaaggtttattttgcagtctggagtgaagaaggcggacaggatgatctggtatggtatgccgcagaaaaaagctctgatcggaagtgggatcgggatattttgattagcagccataaaacggccgggacatatcaggttcatgcttatggtgaagacagtacaggtaagagaacggtactgggaacgaccacgttccaggtttcaagtttaaaaatccagacgatacaggtaaagaatctgctgccggcgagtggaacgtttgatgtgttcttttccggaatccagtcgccatccggtgtaagtaaattgcaggttccggtatggagtaaggatgaccagagtgatatttactggtatacggcggcaagacagagcgatggaacgtatgcagttcaggtaaacctgaaaaatcatgattataattatggaaaatatacagttgcgactggaatgacagcaggaaatggaatttatcagtttacaggagccgtatcggtacaggtaaatctaccaagtgcgagtgtgcgggcggtgctgtcatccgatgaaaaaaccagcagcataacagcggaaaacgttgctctggcaggtggagtacagggagtttattttgcagtctggagtgaggccggcgggcaggatgatctgatctggtaccaggcagcaaaaacaagagaaggcacatggaaaacagatatatcgattagcagccataagagcgaaggggtatatcaggtgcatctgtatggagtagaccggaatggtaaccgtgtatttatgggaaataccacgtttaatgtgtcttatatgtccgtacagaagatacaggtaaagaatctgaataacggaacaggaacatttgatgtattcctgtcggggattacagcaccatcgggggtaagcaaagtacaggttccggtatggagcaaggcagatcagagtgatatttactggtatacagcgacaagacagagcgatggaagttatgctgcacaggtaaatataaagaatcatggctataattatggaaaatatacgatacatacttatgtgacagcaggaaatggtgtatacaaatttaccgggtcgacctctgcaacaatcaatgttccgacaacaaccatgcaggtgggaatacaggcggatggaagaaactgtaatctggtagccaataatgtgggattgcagggaggagtaaaaaaagtttattttgctgtctggagtgagaccggcggacaggatgacctcagatggtatgaggcatccaacacctcctctggtgtatgggtgaacagcttcctactctccaatcataaaacagcaggcgtttatgaggcggatacatatgcgatagacagccagaacaattatgtgccgatggcgagcattaagtttaccgtacagggaccaagcgcttctgcggttaatcttgtaaattataatgagtcagatggaacttttggcgtaaaagtgtctggggcaacgtcgccggcgggaattgcttcggtaaaggttgcagtatggtcagccggaaaccagtcggatctggtctggtatgatgcgacacataacagtgacggaagctacgtcattggggcagatgtgcggaatcattccaataatacaggaacatattatgcggacgcatatgtatatgacaataatggaatcgcattatgtgcagggcgtgtgacatgctccatgattcaggttacaaacctgctgcatcccatcagcggttcgacatctgtgacggtacagcagatggtaaactattataatacaaaagcagtttatccgtctttctaccagaatacagaggcatcgaccatacaggcattctgccagatctatatcgaggagtgccgggcggaaggaatcaaagcggaggttgcattctgtcaggcaatgaaagaaaccggctttttgcggtatggaggaaatgttcagatagaacagtataattttgcaggaatggggagcacggggcctggcgtgaggggggaatcatatccggatgtcagaacaggaatccgtgcccaggtacagcatttaaaggcatacgccaatacagacagtttgaataatatctgtgttgattccagattccggtacgtgacaagaggaacagcgccatatgtcgaatggcttggaatacaacagaacccatacggaaaaggctgggcaacagcaaataattatggatatcagattgttgatatggtaaataaattaaaacagaattaaagaaaagtcgatagagaaggactctatcgacttttttaatgcaaaagtaccagaaaggatggactttataggggtagaaatgttaagataatattaagatttagatcatagtagccatttaacaattctagccagggaaaatgagggaaagatgaagaaaaagaaattatttgtgagtgtcattttattaatagctcttctggtgtctgatgagtcggcggctgttgccgcagcggagatgccggttctgcctgatagcgggatggtgtcagaaagtgagatgcagttggagacagaagaggaaggggatacaacagagatatcggatgagacagcggagaatgtagaagaaacagaatcgatcaaagagacagaaacgattgaagggacagaagcgattgaagaggcagaagcgatcgaagagacagaagaggttgctccttacacagccgaaccgttgagtctttccatagagtatccggctgatataaaatgtggaacgccggtcacgtttacaatgaacgccaggggtgggagtggaacgtataaataccggattcattccttattcaattccgaattgaaaagtgtctatgatgtcagctatggttccaatggcagttatcgggacagcaaccagtttacgtttacattttatgcatcgggcatctattatatcaggttcagtgtgattgatatgtccacctatgagacaaaggataccggactttatgaatataagattgacatacaggatgataattatccttcggtagatcagattgtgtccgacgttactgcacaatgtgaggcggaatgtacaacggattttgaaaaggcgctctggctgcatgactggatcattgatcatgccaattatgattattcgtatacctattgtgctccggaaggcgtgcttgcgaggggaaagggaacatgtgaatcataccattcggcatattgtatgttgttaaacaaagtcggtattgctacaggccgtatagagggaaatggtcatgtgtggaccgcggtaaagatggatggagaatggtatcaggtcgacagtacatgggatgacatgggagatgattataagggcacgatttatgaacatatgtattttggcctgacagatgagattatcagttatgttcacagtgatcataaagctgcggtgccgggttatgagtcgacagcgcttgcagacaattattttataaaaacaggagagatcaggcagtggtcggatcccttcattgatacgatcaggcagaagataaacaatggtcagacagagtttgtgctgccggtcacaagcagtatgccggataattataataatgttatctataatctggtggcatatcagctgtcaaaggaaaactggggaaccaaagcccttaatgttacatacgggagcggtcagcttacctgtaaagttacagataaggcgcagatgtacgcatctgtgacggcaactccggtcatgaatgagacggcatatcacattgtggtacaaaatgtcagtgaaacaggtggaataaaggaagtccaggttgcagtatggagtgacaagggcggacaggatgatctgatctggtatacagctgctccggatacaaagggcagctatgaagtgaatgtacctgttgcaaatcataagacggaagggatgtattacgcccatgcatatgttgtgaaccagcagaaccagaaaagatatattggtggtacgacatttacggtatcttcaccgggagtaacggtgcggccgatggcaccgggaagatacctgctgacactcgaggggctggctgcatatagcagtgatattacaggcgtatcgtttgcggtgtggggacaaagcgatggacaaaatgatctgcgctggtatacggcgtctgcggatcagacaggaaaatggcaggcagaaatttccgttgcggaccatggggagaacggaatttactatgtaagtgcatatacgagaagaaaaaatggaacaaacacctgtatggttgcaacagcatttcagcatacagagtccgtatcggtgcaaagcattgaggtgaaaaacgtagatgcaagtgcaggaacatttgatgtgtttgtaaagggagtcaaagcagactgtggcgtagaatctgtccagctgccaatatggagtaaaagcgatcagagcgatatcgtatggtatatggcatggcggcaaagcgatggaagctatgccacccaggtaaatttaaagaatcataattacaattatgcattatatcagatacatgtttatgtaacatcgggcacacatattaaaacatttgcaggattaacatctgtcaggatagagaaaccgcagatcagcatgcgggcagtcctgtcaacagatgagatgaaatgcagtctcacggcccggaatgtggcggtaggcatggggtacaaaaagatatattttgcagtgtggagtgaacttgggggacaggatgatctacattggtatgaggcggatcaggcatatgtaggaacatggagaaaagaaattgcaatcgcttcacacagaacgcagggaaaatatcaggttcatttgtatggcgaggacgcaggaggaaatcgtaccattcttggcacgacgactttttctgtgtcaaatgtaacagtacagtcgataaaagtgaaaaatcttaacagaacgacgggtacatttgatgtatttttatatggcatcgaatcggcttccggactggaaaaagtccagattccggtttggagtaaggcggatcagagtgatctgatatggtacacggcatggcggcagagtgatggaagttatgccacccaggtaaatatcagaaatcatggtagctgtcgtggcaactatacggtacatacctatgtgacaggaaaaaatggcgtacggatgtttacgggagcgacaagggcgtccatcgtaaatgctccatagtccatacatagaatgctagcagcaaatttgagaaaatagactaaaatattaagacggtcaaaaaagtgtagtccaaaaagtttaggatatacttttgagacagatggaggaagtctatgaaatctcaaacagcattggttgcacgtagttgtcggcttaacgagtgggtccaaatgattcacgattgtaagaatcgccctgctggcatgtccgttgatgaatggtgcaaacttaattctatcacaaaggcaaactattattatcgaatgaggcaagtcagaattgcctgccttgatgcattgcctgcagagacgttagagcatgcagtggttcctgttccgttagcattaatggaagagccggcaggtatttcgcctgtatcttcgaataataattcttgccttgagttatatgcccatggagtgacgcttcgcgtaacggaagcaacttcagagacgctgctgactaaggtacttggggtgcttgcccatgttgaatgatgctacgtgcttcaaacaagtttacattgtttgtggatacacggatctaagatctggaatagatactctggcatcaatcattgatgcgaagacagataacagtccatttgtcccagatacactctatcttttctgtggtcgcaagtcggaccgcatcaaaggcttggtttgggagaaagatggttttctgcttttatacaaacgccttgagcaggggaaatttgtatggcctagaaatgaagcagaagtccgggctataaccattcaacaattccgctggctgagggaaggcctgaccattgctcccaagaaagcagttcgggaaatcaagcctccagaacatatggcatgatgattgtgcaaaaggtagaattttttgccatgaaaaatggtcgtgtaattaccgttttttcatcatcatcaagtcccaaaaacagtattgtaagcgagctattgtgcttttatgtagttgtaatttatatccagcatttcaaaaggattcgatatcatgctgggtctaagccgcttgtagggtcaaacaaccataggcattatgacgaactctgaaatgagaggtattcactatttaagaccatatgcgctataatgaatcttgtagaaatgaggttcattatggcgatggaatacacagaagaacaactgaataatttcgataaggctacgcttgttcagctgtttcttgcccagcagtcacagcttcgcgatattgatcagaagcttcagctattgctggaacaggtcgctgttttgaaccacaaccgttttggcagatcctccgagaaactagaaactgaaaatcagatcagtttcttagaggtggatggcaatatcatttacttcaacgaagcagaggcagttgaaagccttgccgagtatgaagaaaatgaaacaacaaaacccagaggcaggaaagtccagggaaagcgtgctaccgatatccaaggacttccggttattcctgtagaacaccggatgacaaaggaagaacttatctgtgaattcggcgaatggggctgaacattgaccgtgccgacatggcacactggaccatactttgtgccgaacgatatctttccgtcttttacgactatctgcatgaaagaatatatgattatcatgtacttcaggcagatgaaaccccggttttggtttcaaaagagaaccgaacggagggaagtaagcattacatgtgggtgtaccgaaccgacaagatgtatctggataagcagatcgttttgtatgagtaccaaccctctcgtaatgcaagccatccaagagcatttctaaaagatttcaaaggtgtctgcgtaacggatggatatcaggcctatcacaccattgaaaaagagcgtgaagacctacggattgccggctgctggagccatgcaaggcgccgattcgacgaagctgttaaggctttgccaaaggacaggcgaaaaagttcgctcgcatatctggcattaaagcagatccaggcaatctatcgcgaggaaaacaaacttgcatcaatgactatagaagaacgtctaaaacattgccagctaacagtaaaaccgctggttgatgcctattttacgtggatcaaatagaatctattgtctgtaacgcctaagagtaaaactgcaaaaggacttacctattctctcaatcaggaaaagtatctaaaaaccttccttgaagatggagaagtaccgatggataataattccgtggaacaggcaatccgaccgttctgtgtgggcaagaaaaaatgggttatgattgacaccatagctggtgcagaagctagtgccatcatctacagcattgcagaaacagcaaagtcaaacaacctaaagccttacaattacttcgaatatcttttaactgagataccaaagcacatggaagaccatgatgtaagtttctgtgaagatctgctcccttggtcagacaagctgccggcagaatgcagaaagtaattcgttgactaacgccgctcttcggagcggctaatcaaaagaccgcacccactatggtgcgtttacgataataaaaagaaaaagttgatttgaggatgaaaatggatcttatgcaagttttaatggaagaatataaaatgttggggcaggtgggagaaaagtattttgatagattatatcaaagcctgtattttaccattgttttttatggggcggtcttggcagtcatgaaatcagaagacaatgaaaaattctggttcattatattttgttattttttgccaataggaacctttttatttggacttttttatgcatataattcttatgtaatagcaaggcaagggttttgcatgattaggttagaaaaaatgattcgggaacaaggtctgtacgcatataagaatgcaggttttgcgggatggaatatattatctaaaaagtatgcaggtaactataagttagcatatgggacatcattgatgttttttgtttttgcacccgtttttgactacatattaggaattggaaaatcagattttaaatggataataaattttacatccattacaggattaaatattttgtacagtatatttccaatactattttatgtggtatatgttatttttatgataataatgataaaaaatatgttgataatgaataaaatgatctatgtggaattataagagaaattcgtgtgccgttgaaaaggagaatgaatgatttagaactgcggttttggtactaagggcaatagtgcttatagaaaaatatattcggaggaccaatagtttcattgataataacggaagtagtagatgcgatagggtatacaaaggtgttttttgtggcgtgtatattattgacttaaaaaattttaataaacattggaaattacatgaaatgttataaatgataagatacgaaggtttgcaaaaatgtatggatgtagtagaatataatgaaataaactacatcacatggaaaacaggacgataatgttgaaaagaaggtagtggaaaagatggataaaacaatggtggaagagactacgataaaagatctgaaggactgcatggagaataatatgccagtgctgtttttgggtgctggtttttctcgggaagccctctgcaaaaaagggaagcttcccacaggctcggagcttgctgatgaattacgattggagtttgtaaaagacaaaatcagtgaggcagattataaggatgttgaaaaatataatcttcgtgaattgtgttcctgtattgatgcattagataaggacaataaagcaaaaagagaagagtatcttacaagacgccttaagggagccttgccaaatgagactggatttcacaatttgctggtggattatccatggaggagaatttatacggtaaatattgatgatctggttgaaaatatatatgaagaaaatgacaaagagtacagttgtatttcatcaagtaaagatattccccgcaaaagtgaaaacatggagctcattaaattacacggcagtgtaagaaaaccgggggatggctacatattcagtaaaaaggaatataatgatctgatcggaagcaaagtgaatatcggtcttgtagaatttacaaatgaaatatattctgcaaatgatgtcatatttatcggagcttcactggatgaaccggatattgagtactatttacagctttatgaaaatatgcagataaagagaaagaaaagccgtattttctttatagaaccgtatcccaaattggcgttggagcaaaaagcggcagagttgggggcgaccattattccgtggactacggagaaatttttaaaatttgcatcggagctggaatatgcaccggagagagcagagcgcgccagattagaacttaaccgggctatgatctatcggcttcaggatgatataaaaatttttaaaaatccatatgagagtaatatatatcagggatattatagcacctggcaggatgtttttgacagatggacatttgaaaatacgatgttagacagtgcgaaaaagagtctggatattattttgagtcaaaaagatccactaaaatgcttttgcctgtatggaagctctttttcggggaaaagcacacttttaaaacagctgggctattatttgcatagtatgggatatgaggtacttgaatataagggaagatttttagagagaagtgtacttcgcaactatattatggaaagtagctatgaaaaatatgcaatccttatagataatgcaagtttttattataagaccattgagagatttttgagagacagttatgaagaaaaagaaattgtttttttgtgtgcgtccagaacgtattatcatacaagaaagaaatattatctggaagggaactgtttttgtgatttagaatgtaaagacaaaatcaggaaagaggatgcgcccattatagcacaaacactggaagagaaggattcactgggagatttgtacgaattcgaccatgattcaaatgagctgtatcgggagattcagaggaagcagagtgttgtgaatctgatcgtatatctgacttatggcaaggaaatgcggcgaaaattaaataaggaaatgaagtttgtaacggatcttccgccgatagaaatgaaattgctgctggaagtggcaatatttaataatctggatattgaatattatccgatcgaattatttataggacgttatcagggggtaattcgtctgacggaggagggcgggatcagtaacctgaaggtgatagattatattaaatatgatgatcagggaattgctttaagaaactctctgcttcaggatgcggttttgaaaagtaacagggataaaatttttcctgcaatccgggaattgttgctttatatgtcgacttatgtgtatgaaggaagacaggatgtgtggatgaatgtattccaagcacttttaaatgaggccaggttaagagaaaagtttaagtcggaaaaatcggaattgggtactttgttttatgggattaagcaggaatatacaaaggtcagctattattggcttcaactgggcttatatgaacagggagagaataattatgcaaaagcactgagccatttgaaaaaatcccaaaagatacaaccgaaatcttttaagatacagcatgcaattgcaaggaattatcttaaatatgctaatgtacaatccgacagccagacagcaaaggaattgtttgaaaaaggcgaaaagttgatgctagatctgatcaaaagtaaggagtattatattcaaaaagcaaaactgttttctgttgattcttatgtgctggaaaaggttagatatgtagaaaagtttcatgtaaaacttagtaataaggagttgaatgaaatgagagatatgctgagcgaggtttattcacctaatgattcctacatttataaggctatgaaagttttctatcaaatgctatgcagaataggaaaacaatccatcatacgaatggactttaacagtccttattatgatattatgaaaaaagaatttgcaggagacgatgagtttgaaaatactatttattgtgaggagtaggtattatttaccaaaaatattgtattgattagtaaagtgtcaaaagaaatctgatctgtgtgttttaataattcataattttaccaaatagacatttgacgaaaaagagatttataatactcccatagacaggcacttcccaatgaggaggtacccatgtatgggagaatgttttcagacattgaacttgacaaatgcatatttgtttgcagcggcgctacaggatgaggaaatctgtcggaatgtgctggagatcgctttgaaccgtaagatcactgcggtcagatcgcacgcagagcatacgctcttcctcgacagcgatttcaaatcggtgcgctttgatgtgtatgcgctggatgctgaggaggtcagctatgacgttgagatgcagaatgattttggcagggatctgcccagttgctgcacctgtttgaatatttgaaacaaagcaccgaagaagttgccaatatgcataacgatgaagagattcaactgatccaccggagggtggaatatttaaaacgtgatcgaaaattggaggcgggctatatgacgatggaggaatatagccattcggaagcggagcggagagcaaaagagatggcggaaacgctggcaaagccaatggcagagtcactcgcggcttcaaaaatagcgcagaacatagtggcgttattagctgaactcggaagcgttccggaagaattaagggagtgtattgcagctgaaaagcgggaagatactctggcggcgtggcttaagcttgcagcacgcgcggattctattgaagagttccagtctaaaatgtagagacagatctgtctcattcttgatcggtagtttcaaccgataaaatctacaaaaataattttgggatgtgcctgtctagcaatctgcaatagaaagtggaaaaggaaagagaaatatgttaacataattgttgcaaggcaggaaatttggaatgccatgtggtatttgtgcaaaacaaaactactataatagaatgaaaacggatacacaaaaatctgcaatgatagaacaaatgatgggtggaaaaagctatggcaacatatgtgattggtgattatatcagagagatcaggcttcgtaagggctacacgcaggaggatgtaagctttggaatttgtacatctgcaacactgtcgcgcattgaaaatggagcgcagacacctggcagatatatactggataagttaatggaacgcctgggtatggagaacagtgtgtttaatatcttcgtgagcaaagaggagatggaactctatgagtgtgtccaggaaatggtaagaaacattgcggatgggaattttgaggaattggtaaagcagattcagaaagtagaaggtctgacaaagaaaacatcacacttggaaagacaatatttatactttgcaaaggctgaattgatgtggaacaaaggggcagaaccggatcaaatcatggaaatgctcatgaaggcaatccatgttactttgcctcagtttgacggtgtgacaccgatgaaggaaaatctgctcacatttgatgagattatgataatcaatgcaatagcaaggaaatatgccagagaaaataatattgaggaagcattgaaactagaatactggttaaaggattatatggaagagcagatgatggacagtaaacagaaaacggcaaaatatcctgtcattttatataatttgagtaactggctggctagagtacaaagatatattgaaataaatgatattgcagaagaaggagtagaattttgcattaagtatggcaatttggttattcttcctcggttattatttaataaagcctgtgcattagcagaacttggtcaaaagggtgaagcagtcaaatatttcaggcagtcagtcgttctgtttgaaacgatgaagcagaatgagagagcatgcagagcggctgactactgtaaaaataattatggtattgaattttagtatccctcagccatatcttcgaaaataaagcatgaagtcacgccggatgataccccaaaagaattgacgatacctggtactgcggctgcggacaagatgagtgcaagtgtggtgataataaatgcttttttcataaacaaatctccttttctgttgctttttttgctatattaggagaggttttgacaaaagaccattcgatatgacgtaagtttaaatttacgtcatatcgaatggtcttttcctgtcgaagggagtaaaataaactaatttcacacatatgaaaggaagagataaaatgatagaatgcgtaatggtagacacacttccggagactgcaaatcagatccttaatattttgtgggatcgtaatcatgcaatgaatgagactgagatcagggaggcattggagcaggaattttctgtgaagtgtgaaaagcaggatgtgaaggatttcataaggtttctgatcgggcaggattatgtggagaagaagcataaagggttgaagacctgttatgtggcactgggagctgattacgtcttataagcatatgcttttgaggaaaccctcatgatatcagaaagcggtgtgaatagaagtggcattttggagcggaatgttgtagaatataaaaagtattacgacagaaggagatgctatgaagatttcactgatagtcccctgctataatgaggaggaagcattgccgattttttatcgggagacgaagaacgtgttggaaaccatgccatgcgagcatgagtttgtgtttatcaatgacggatcgagagaccggacattggctgtcttaaaggaactggcagggcaggatggctgtgtgcagtacctttccttttccagaaatttcggaaaggaagcggcaatgtatgcaggattttgcaatgtcaccggagactacgttgcagtgatggatgctgatatgcaggatccgccggcgcttcttccggagatgttagacaagcttctgacaggtgaatatgacagtgtagcaacctgccgtgtgaccagaaaaggagagccgccgattcggagctggtttgcccggttgttttaccggatgatcaaccgcgtgtcagatgcggatatcgtggatggggcacgggattttcggctgatgcggcgtgagatggtagatgcgatcgttgagatgggagagtataaccgtttttccaaggggatttttggctggatcggatttcggacatgctggctgccgtatgagaatgtgaaccgggtggcaggcgagacgaaatggaatttctggaagctgtttaagtatgcgattgatgggattatcaatttttcacaggcaccattggcatttgcatcctggtttggaatgttcatgacagtgttgtcctttgtggcggtgatttttattattatacgaaagcttgtctttggagatcccgtgaccggatgggcatccacagcgtgtatcattacatttattggcggtgtacagcttttttgtatgggaattatggggcaatacattgccaaaacatacctcgaagtaaaaaaacgtccgcattatattgtcgcagagagcaatatggacgaagtgaaacggataaaatagcctgttttaggaaatgtgcacaaaaaacacttttatacgcgggtgaagtatggtatgataaaaataagggcgcagtttgaaattagaaaagcccttaattaataggatattgagaggtatacattgtgaagaaaagagcagtcaccttattgacattgtttgcggtttctatcaaccttatggcatgtggtggaaaggatgctcaggagagcagcgcggacacatcgactgagcaggttattgcagagacgaccgaacaggcagagactgagtctgaggaagaagtgcttccgggaggcaaataccggagcgaacttacgaatgaactgatcgatgattccttgaaggatcagcgtccgattgcggtcatggtggataatgagtctattgcgttaccgcattatggattatcgcacgcagatgtcgtatatgagatgatgaacagtacaatgaatggtcgtattaccagatttatggcactgtttaaagattacgagagcgtggatcagatcggaagcatccgaagcgtccgcccgacgaatattattctggcagcagaatggaatgcgatcatttgtcatgatggaggaccattctatattgatgaatatctggcagagccgtgttccgaccatttcagtgggacattttcccgtgtgaacaacggaaagtcaagagaatatacggagtatatcgtttccggtgatatggacaagaacttcagtaattcggatgtgtccaaagagtatacatcttattatgagggtgagcactatcagtttgcaaatgaggacaacccggtggatctttcggatgcagcagacgcgatcacagcagagaccgtggatcttccattcccgcataatggatcctatctggagtacgatgcagatgatcagttgtattattattccgagtatggcaaagcgcatgtggatccgggcaatgataatgcacagctctgctttaagaatctgctgattcagagtgcaggatttacacagtatgacgaacatggttatatgatttttgatgtgattacatccggtggtggatattatgtgacgaatggcgaggcgattccggttacctggaagaagacgagcatgacttccccgacacgctattatgatgcagatggcaatgagatcaagttaaataccggtaagacgtatatagcacttgttccggtggatgactggaagagtctggtaattgaataaaacataggtgacagaaaaagacacgtccatttgggcgtgtcttttttttgatctttgccattgatttcttatctgttaccagtagcaggcattgtccagttcttccagtccttttttgtccttaggagcttctgcttttggtggacgaacccaatattcatttttgagagggaggtagggagggtagtcatcccaacgcgatccccagatcccgaagagcagctgcatggatccccccatctgaatggcctgtttgccggcgcgttttaacatcggagccagattatagccgaaagcactgcagctgagcagggcaatatcaaaatcgatcttcatgatctcctcatacatataatttaaagcatcaaaccatgtgtcaaaatcgtctccgcgtccggtgaaccacacggctttgaatgtgcggaatgtgatgtcaggtggaagaaccatacgatccgggaagatctgatccatgtgggggtactgctccaacatggtatctacgaatgggttgacgagaagaacctttttgccggcaagagccagtgtccagggctctttgtaagccaatggttccaactgaccgagacggatcagcttcatatcttttggacagctggtgcgtacaatgtattcttcggcaggatgatcgtcaaagtaagccatcacatcgatatcctgattatcacgtttgatcagagacgaccagcggccgacttcctctgtgctgtggtgaaacgtttcaaacatattactcttaccaagacggttcgtgtggaagaggacatgctcgtcgtagagctgcaactctgaaaactcagcgctgccaaggcgacagattgcaaatggcttgccgcttttgataaagtccttgatcagctcattggcttcttcgtctgtcggagccggaattcccagaaaagatccgagaacgttgtaacttccggtgcgtctggcgcggagtttatgatgaatgtgcttcaaatagtagtataaatagagaaccctctgtttcatgaaatctccttatagaaagtggtcaatacgcaataatttttattataaatcctgcgtgtgcaatgtcaagggaaaaagtggacttcgttgacaaaacaacggtgtttggagtatgatgattgtgtttcacagatgaaagaaaaccggagaaaatccggtagaatggagtagatatggagaagattttggtgacacgttcatccatgcctgaactggatgagtatgtggacgagataaagagtatttttgaaagccactggctgacaaatatgggggagaagcataacagattggaggaggaactggcagaatatctaaaagtgagaaatattctgctgttttccaacgggcacatggcactggaacttctgattcaggcaatgggacttaccggagaagttatcacaacaccgttcacgtttgcatcgaccacgcacgcgatcgtccgcaatggactgacacctgtgttctgtgatgtgaatccggaggactacacgattgacgtaaataagatcgaggcgctcatcacagagaaaaccagtgccatcattccggtacatgtatacgggcatctctgcgatgtcgaggcaatcgaggcgatcgcgaaaaagcataatctgaaagtcatctatgatgcggcacatacttttggcgaggaatataagggacgaggagtggcaacctttggaaatgcctccattttcagcttccacgcgaccaaggtgttcaatacaatcgagggtggtgctgtctgctttaacagcagtgagaatggtctgcgggaaaagctgttcggcattaagaatttcggtatctgggatgaggaacttatcaaggatgtcggtgcgaatgccaagatgaacgagttccaggcggcaatgggattatgcaatctgcgccatattgacagagaacttgcaaagagaaaggcagttgtagagcattacaatgagagactgtccggtgtaaatggattaaagatttctgcaccgcaaaaggacgtgaagcctaactatgcatattatccggtaatctttgaaccggaggaatttggaaagagtcgggacgagatctatgagctgttaaaggtcaacgagatctacgcaagaaaatatttttatccgctgacgaacacgtttgaatgctataagggcatgtttgatatgggagatacaccggtagcgctggatctgtcgaaaaaggtactgacccttccgttgtatgcagatcttcggattgaccaggtggatcgtatctgtgacattattcttggcagatagaagaatctgccggtggcggatgttgtgggaatttacaggaagaatgcaagcgtggaaacacaggagaaacagggaggatcatgatttggtaacggttaagatcggcgatggcatgggcaaccagatgtacaactatgcctgtggctatgctgcggcaaaacggagcggggaaaagctcaggctggatatatcggagtgtgataattcgaccttgcgtgattatgagctggatcatttccgcgtggtgtatgatgaaaaagaatcctttccgaaccgcacattctggcagaagctctacaagcgcctgcggcgcgatatccggtatcatgtgatccgggaacgggatatgtatgctgtggatgcgcgggtgtttgtaccagcccggcggggcaggtatcttcatggctattggcagtgcctcgggtattttgaagaatatctggatgatctgcgcgaaatgtttacaccggcatatgagcagacggatgcggtaagagaactcatgcagcaattcacacagacgccgacttgtgcactacatgtgcgtggaggggatcttggtggcccgaaccgtgcgtattttcagcaggcgattgcacggatgcagaaggaaaaaccggatgtgacgtttattgtgtttacgaatgatcttccgaaggcgaaagaatgtctggatgacggagaagccagaatgcgctatattgcggagtttggggaagcactgtcggatattgatgaattctttctgatgtctgcatgccagaatcagatcatttccaacagtacctattctacatgggcagcgtatctgaacacgctgccgggaaggattgtcattgttccgaagtttcacggggtagagcagatggcattgcctgactggattgtactggatggcggcgcatgtcagaaaggggagatcgatgcagtttaattcaattgactttctcgtattttttccggcagtagtgctgatttactggatcattccaaagaaagtgcgctatctctggcttttggtggcaagctattatttttacatgtcatggaatgcgtcgtatgcgatgctgatcggagcctcaacgctgattacctatgtgtgtggacttcttgtagagtggaccggtacacatgaggaaaaaggctggagcgtggcaggaaagctggtcgtcgcggttggtttcctttccaatctcggcattttgtttttttgcaaatattttgactttttccttacaaacctgaatgtggtgctggagcattttcagaaaaaaccgttgaccagcagcctggaggttctgctcccggtgggaatttccttctatacctttcaggcgctcggatatctggtggatgtctaccggaaagagattgcggcagaaaaaaatccgcttcgctatgcgctgtttgtatcatttttcccacagctggttgcaggaccgatcgagcggtcgggaaatctgctgaaacagatccgggaagtgccttataaaaagacatttgaatatcatcggattgtcaacggactcatactcatgttgtatggatttttcttaaaaatggtgctggcagaccggatcgccattgtggcggactatgcatttgaccattattacagcctggggagtgcggaactggttaccggggcggtggcgtttgcaattcagatttattgtgactttggaagttactccctgattgcgatcggggctgcacaggtgatgggcttcacattgatggagaattttaatacgccgtattttgcgacatcgatcaaagatttctggagaagatggcatatttcgctgagcacctggttccgggattatctctatattcctcttggcggaaaccggaagggaaaagtgagaaaatactgcaacctgatgcttaccttcctcgcaagcggactctggcacggcgcagcatggacgtatgtgatctggggtggactgcacggactctatcagatcatcggggatctgcttcgcccggtaagaaagaagatcgtggagatctttgacgtccgaacagattgtatcagttttaaactgacacagattgcgtttacatttgtgctgaccacatttgcatggatttttttcagggcagacaatctgggacaggcgtgtgtatatataagccggattgcaacaagagtgaacccgtgggcgctttttaacgggacgttatatacaatgggactggagcagtttgaagcaaatgtgttgttttttgcactgttcattctgttgttggttgacctggtacgttatcggctgggcagacgcgtggatgtgtttttgcaggaacagaatatatggttccggtggctggtgtgcctgttgctcattcttcttgtggtcgtgtatggaaaatacggtccggattatgatgcggcacagtttatatattttcagttctaaagaagagcatgaggaaaacaatgaaagaaatgataaaacgtacggcagcctgtctgctgtttgccggtcttgcagccgggatgctttatggggcttaccgcctgctacattttaaatcgacagatggctgttatccggcggagatgttctatcagcaggaggagaataccgttgacgtcttgtgcctcgggagcagtcatacctatacgaatattaatccggctattttgtgggatgaatacgggatggcggcatatgatcttgccggatcgaaccagacgttgtggaatacttattattacatgaaggaggcgttaaaataccagacaccacagcttgttgtggtggatgtctaccgggtcatggaggaggatgagtaccaggggacagagcggatgacgatgaacatgtttggcctgcgccattccgatgattatgtggaaaatctgcaggtcagccttgcgcctgaggaggaacagctcgattatctgctgcggtatccggtgtaccatgcgaggtaccaggaattaaaagaagatgattttctgccataccatggagatgcaaatggtagaaattacaagggatttaacattaattccatcagtacgactgtgtttgagggactcccggatgtgacatgggtgacggaaaccggtaagatggagaaaaagaatgaaaagtacctgaaagagattatagacctggcaaaagagcaggatatcccgcttcttctcgtagctgctccctatatggaggttggcgaggaggatgagatgttatataatcaggtggcagagattgcggcagagcatcaggtggattttgtggatttcaacagacagtttgaacagatcggtctggatccgcagaaggattttgcggagagcagtcacttgaattattacggaagtgagaaatatacaagctatctgggtaattatattgcaaaacattttaaggtcagtgaccgcaggggtgataagcggtatgattcctgggaggcaaacagccgttactatgaaaaacatgcccagaatgtggatttgaaaaagacgaccgatgcgaacgcctattttaaaaagctttttgcaaacacggatcgttatacgatctgtgtgatgacgaaaggagactatcgtagtcagaaatggccgcttataaagtccatgctgaaaaagtatggaatggatcctgacaccgatactgtgtgggtatggaaagatggagaacttcagatgaccgttccggcagacaccacagaagataaggtctattatcaggatctgggaagaaagagtgtgacggtgctcacggaagaacggtatagcgccatgctggatgatacttatctgtatcgggaggtatcgatcgaggggatcaactgtgatgcggcggaaaatgggatcaatattatggtatacgacaatgaattacaggaaatggtagacaatgcaggaatgaatgcttctgacgggtatgcatttatgcgatattagaaaatgaggatgagacggatatgaagaatacgctgattaaaattcagaacttttttctggcacttgccatggtggtgcgccatccggtaaaggcgccggagcttatgctcgcacgccgcaatgaggaagaacttgcagcggatatagaggcaatcaaccgggagagaatccgtacattgtacggacaggagcaggaaccggctgacccggagctaaaaaaaaaagagtatagaaagattaatgagtcctacgaaaaacgcctgatcttccatgtgggatttggggcaggtcttttttccgagctggacagcatgatggagcacatgcttttctgctttgaaaatcatatccgctttgagatctatgctgatgatgccaatttctcaaaagcgggaggaatgggatgggaggaactgtttgagccgttctgcccgatcaatcacgataagctgaatcatatcgcaaattatcgcccgacagactataagagcacgatgcgccaccaccgcctgtggtataaaggatactttttgcccaaaatcttaaaacggcgtacgggtgccgactatctgacacaggatatctggtgtatgtgcatcaataatgattttaagtatcatccggtggattttccactgtttgggatgaagggaacagccacctctcagttttcaaaattcggggagatcgcgatctgtccgaaaccggatgtgcgcaaggagatggatgcactgatctcaaagctccatatgccggaacattttgtctccatgcagatccgcggcggcgacaaatgcctggagtataaggagttaaaggatgcggcaagctatgtggaaaaagtggaggcactgggactgtccggtcagccgctttttatctttacggacgattacacgaatgtgacgaagatccgggaactgcgcccggagtgggagttatatacgttgacaggggaggaagagcgcggatattacaatgaagcgttcaacaggcaggactgggagttccgcaggaagaatcttatcaagctgctcgcgatcgtggagttgtgcaaaaaagcagattatcatatcggaccaaaccagtcctgtgtagatttgtatctgcgctcggtcaaaggactggagcgttatatcgtgctatagataacggattggatcaggaatccgggccattaaaaagagggactgtcgcaataagcatagatctcttttgggtgataagtaatattataagaaacacacttgaggatttcaggtggaaatgcagatggaatattcgttggagaaaaatgtgagtatttcttccagtggaatgtttgcatcggattccgtgtctcttccacgtttggacaatccgacgggtgcatgtccgacacaccggagacaatgggcggactttctggtgtccctaatggcacctcttcacagacaatataaaaccgcgcgaaccgaaactcgccggcatctgctattgaaaatatggcagatgccgactcagacatcggcttcgcgcggttatgttttgttcagaggtgccaataagggacacacaaaagtcctgcaaattgtcttccgggatgcggacatggcccgcggagtgctccaaacttggaaagacacggatcatcgaagatgcaaacattcggctggttagaaattccacatttttcgctccgaatttccagatgaattccatctgaaatcccatggtgtgggcttctaataatattacttatcaaagcaaaacacgatatgcttagtgcgacagcccctctggctttacaggaaaatgtgtccgatggagcgaagatcgtcggacgggatccatatgggatcagtcggtcttacggatcacggtggcaggattcccggcggcaacggtatagggcggaatatcgtgtgtgacgacacttccggcaccgatgacggcaccctcgccgattgtaacgccttttaagatcgtaacaccgaaaccgatccaggctttatccccgatgatgatcggagcatccctcacaaccgaccagtccttgtcgaaaagtaccggtctgccttcctttaaattggtatgctctctggtcacatccatgctgcgtccggcagagtgggtggagtgggaattgtggtcgtagattgtgcagttccatgcgatgatgacatcattgccgatcgagatctgattgcgggagatcagctgtgtgccacctccgatgtgtacgcggtcgcccacggtaatggttcctgtctctgtctcaaagacgaaggaggagtcgatgacaccgccatcgccgatcgtcaggtatgtcttcccggactgtggtgcgcgcagatcaaggttgaaattgtcacagagcaccgtgtccggtgagatggaaaaataaggagcaaaggtttgaagctgtttttttcgtttgtattttttatagatactgcgaaggttcatgggaatccctcctttttcatgcaaatggaagagttacttttttctgagaaactgtaccatgccatcatgtgcacggcggtatccgtttatgagagccggggtgcaggcattgaccggcttcatgatcagtgcggcgagggcaccgtcaatgcgatcaaagagcagtctgcgcagctcgttgagcaggatacagaacaggaacacgacaacggcaaatacgaatacaatgccgatgaaataaggactcttggtgtacggcgcaagatcgaagtactgccagaagaatttccgcgcgtacccctcgatacagtacaggatgaccacatcaccggataagtggttgatgatcctgctggaaaaattcatctcccggaaaaacaggaagaaggagatggcggtgacagcgatcaaaatggagttgtcacgacagtacataccggtaaatactcctttttttaaggaaaggatgatatttagcacggtggcaagaatcgataccgaaaagaacacggcggcaagtttcttttgtgaaaaagagagatcgcttaagtgcaggcggatataacggccgatcagatacataatcgtcatacatacgacaccttttccggcatcttcgatgatctcgtagaagaagaccgtcgggatcacataaaacaggaacagtaacagcaggatcagattgcggaaagatttccggtcaagctgttccgggatcttattcaaaaagctggaaaggatcgtgatgacaaaataataggaaatgaaccagtggctcttgaaggtgatcggcatacatgcgatgatcagactcttgattccgaattctccgaagaggaaaaggtggagcaggtcataaaagataatggcgatatcgagcttgatcagcttttccagattgaaccggatgccaaaatatccggataccatcatgaacagcaggttggtattgtttgttaatgtgttgacaaaggaactgccaactaaattgcccgtggaaagatcatttgtataaggcccgatgctgtgccagaacacaacaaaaaagatgcagaggatacgaatcagctcaaagctggaatttctttgttttggcatggtgaaaataccctttcttcatttattttattgaatattcattatagcaatccagaaataatttgacaagttgttgttttcttaatatgattaagattggtattttataagataaaggagaagactatgaatcagttaaaaagcgcctttgaggttttcgacaaaaaacagaaacgaagtcttgtatatctgacatttatcatattcatcgactcatttgtagaattgctcggtgtgacggtaattctgccgtttatcaatgcggtgatcgcaccggaacagcttctgcagaataagttcgcagcgtgggcatatgatacgcttggcatgaagaacaccaatgagtttatcattgtcattgcagcgatgattattgccgtgtatattttaaaaaatatttttctggtgtatatgtacaatctgcagtataagttctcctattacggcaagaagcagatgcagaacacgctgatgcgctactatattggtcaggattatacctttttcctgaatctaaacagtgcggagctgatgcgcaatatcaataccgatccggagatgttctataccgcggtgctcaatgccttacagatggcatcggaactctgtgtcagcgcgatcatcgtcatctttttaatggtaacggatgtgacgatcacgctgggtgtggcagccagccttgcgatcatgatgctgatcctctccaaaggactcaaaaaaatactggaaggctatggaaatgacagaagaacctactctgcaagtatgatcaagtgcatgcagcaggcatttggcggtatcaaggagattaagattgcaaaccgcgaagagtttttcgagcgtgattttgagaaacagaatgagatctatacttatgttatcaaacagaactctttcttaagtgcactgccaaagccgatcattgaggcacttgccatcgcaggtctgatgggaatgattattgtcaagatcgcgatgggaaacacgaacaatgcgcactttatcgcagtgcttggtgtattcgcagtggcggcattcaagctgctgccttccgtcaataaaatttcttcctactatgcgtccattatccacaatggcgtcgtgatcgacaagatccgtgatgagtaccgtgatatagaggcgcaccgcgaggcacgtgccgaggcggaagcaagaaaagcagaggagatcccggtaaccctggagaaggaaatccgtgtggaacatatggagtttacttatccgaatgtggaggagccggtgctttccgatgtgaatgttacaatcccgaagaatgcgtcggtggcgttcattggaccgtccggagcaggaaagaccacgtttgtcgatctgatccttggtgttctgactccgcagaagggtgtcatcatgaccgatggtgtggatatccagaagggaatgcgcagctggcatgacaagatcggttatatcccgcagaccatctatatgcttgatgatacaatccgcaataacattgcatttggtgcaaatgaggacattgatgatgagcggatctgggaggcattaaagcaggcacagcttgacgatctggtacgtgagatggaggaaggtctggataccgtcatcggtgaggcgggtgtgcgcctttccggtggacagagacagagaatcggtatcgcgcgtgcactttaccgcagaccggaagttctggtgcttgacgaggcaacttctgcgcttgacaatgagacagaggcagctgttatggaagcaatcgacagcctgcagggcaagatgacgatgctgattattgcgcaccggctgtccacgatccgtaactgcaatattgtatataaggtagaaaatggtagcgtgacagtggatacacagcgccacaaccagtagaccggaggggatggaacgaacatgataatcatagaaccatgtgcaggactgggaaaccgcctgctggcactgacttcagcgtatgaattggcggagaagctgggaagggagctgcttgtcatctggaagagcgagataggctgccagatccggtcagaggagctgttcctgtttgatggggttaaggtgatcaatatcagtgagagtggatggaagcaggattttgccgggacactgcgcggcaatgccgtcaagaaaaaataccgtggcagcgcagaccggtttgtggagtgtgatgaggtagaggtctggaaaaaagagggtggatttgcgcgtgtggaacaggagattgcgaaaacgtcccggatctacatcaaatcctacacaaatctgtgcgagatcacgccggacagcttcaggttcttaacgccttccgctgcggtggaagcgcgtggcagagaagtgtttgcccagatcacaaaggagcggacggtgggggtacacatccgccgtaccgaccacacagatgcgatcgcaaacagcccgctggagttgtttaccgatcggatgaagcgcgagatagaggaaaaggatgccaatttttatgtgacgacggacgatgccagggtcatggacgagttaaagcaggcatttcccgcagagcgtctggtaatctacgagaataaggtacttgaccgtgattccagggagggcatacaggatgccctggtggatatgctgtgtctgtcaaagtgtagcaggatcataggaagctaccggagtacgttcagcctgatcccttcgatcatgggaaatattccgctagagatgatgataaaggattgagaaaatgaaaacgtgtacgatattaggaacagagattgccgtcacgacgatggaagagacggttcgctatatagaggaacacatggaggaactgcgcgggaaatatatctgcgtctcgaatgtgcacacgacggtaacggcatatgaggatgaaagctatcgcaaagtgcagaatggtgccgcatttgccctgccggatggaaaaccgctgtctctttattcaaaaaagcacggattcccggaggcggaacgtgtgaccggaccggatctgatgggagaactgttcgcgagagacaatgggctgactcactatttttacggggggagcgaggcgacgatcgggacactgcgtgagaagcttcccaaagaatatccacatcttaagattgcaggaatggtgtcgccgccgtaccgccctctgacgaaggaggaggatgcggcgcaggtggaggcaatgaatgcgtcgggagcagatatcatctggatcgggcttggcgcacccaagcaggagcgttacatgtttgagcaccagggattgacgcagggcgtcatggtcggtgtgggagccggatttgactactatgccgggacgatccggcgcgcgccgatgtggatgcagaagttgagcttagagtggttataccgtctgatgcaggatcccaagcgtctgttcaaacgttattttgtgacaaatttcaagttcctgcggctgacacttggaagggggaagaagagcagaggagagaaaaagtcatgacagaggcgaaggcaaagtaccaatacatggatgtggcacgggggctggcattgctgttggtcatgatctcacatgcgcacggactcagcagttttctgattttttactatatccagatctttttcatcatctcgggctatatttataagcctgggcggagttacggggacaatatccggcgcaaggcaaaacgccttcttgtgccttattttggttacagtgcactgctgtggtgcgcgtatgccctgatccgccgggatatgggagagatgaaacagtcgctgtttggcattttttattcgaggttctgcttgtacaaaaatgcaacgcacacagagaatgtctatctgttggatattgccaacggagcgatgtggtatctgactgcattttttgtgacctgcctgctgttttatctgatcgcagacaagtgccttgcaagtgcaaagacaatggcggtcacatcggtcgtgctcgttgccgtgacgatggcattaaacgaactgcccattcttcttccgtggagtatggatattgtgccggttgcggcactgctcatgctggtgggagcgtggatgcgcagatatgagttttttgagagaaaatggaatctactgtggatttttgtgacactggcagtctatgtgggaacggttgtattcaacggcagattaaatatgtccatccgcgagtatggacggtttgacagtttcagcgtacctttttttcttgtaatctcgctgaccggatcaaccttatgtatctggttttgtaaatggatcgggcacacgaaggtagggagcggtctggcatacattggcaatcatacgatcgagttgatgtgcctgcatatgttcggtcttgagatgtttgaggtaatcgcgtcgcatgtcatcccggtacaggaactgacaggagtggcggagtggatttatgtagcagtgcgcgttggcgcagcggtctgcggctccctgctgtttggtgtgggtgtgtcgtgggtcaaaaagaagagaggaaggtagcatggagaaaaaggaaagagattcaggtctggagcttttgcgcatcatcggattgttcctgatcttctggatgcatggggcgagcagttatgtaaataattcgctgagtgcctggctgtgtattgtgattgagacaatcggaaatgtcggggttccggtctttatcctgatttcaggatatttcgggatccggttcaaacctaaaaaactcctgcagctggatctgatgctgatcttttactgctggaccggtcttgcgctgcgctttgcgtggggagatgccgcagagtatggaatggaacagattctctcctatgtacttccggtcattggccgcaattcctggtattttacctgctactttgcactggcgattttaagtccgttcttaaacgaatttgtggaaaagctggagaaggagaccttccgcaggatgcttgtgctgatgttagtgatcttttcgggtatcacgacatttctctttttcgatatcacacaggatggcggaaagggaatcgtcaatatgaccctgttgtacctgatcgggcggtatatccgcctgtatcaggataaaaaggtgtacagccggaaaaaactcatcacggcgtatgttgccatcatggcagtctgtattgcattaaacggggcactgtatgtggtgagtggtacggtgcagaatcggttttcgcgtgacaatacgctctttacgatcgcagcttcggtgtgcctgttcctgctttttaaggatctgcattttcgcagtaaggtggtcaaccgtctggcaacgcatgttccggcggtctttacgatggagtggacgctccgcggagtggtcacggcgtacatgttcgactatctggcgtggagggagagcaactggcatgagctgatcctctttggggtatgcttcctgctgcttgccatgggaaccgtgatcgatgaactgcgtgtactcctgctcgggcgggcagaggaaaagcttgcagatctggaataccggggacttaccaccgtctgcggtactctgaagcggtgcatccttcgatttttttaaaaactttattaaagtaactggcgtcatcaatgccacagtgctgtgcgatggtttcaatggaatcgttgctgtaacggagcagctctttggcattggtgattttttttgtcagcagatactggatgatcgttgttccgaattcttttttgaactccctggaaagatagtacttgctgatatagaactggtcggcaagctgatcgagggagatattttcggtatagtgttcgttgagatagcgaagaatatccttaagcttgacggacagcggggagtcatcggcggactcgcgtggcgcatctgtgcataaggtggtgaggatggatacgatctgtgcggcagtcagaaggtcggcatcgtccgtcttttcttcatgcagcgtaattacgttctggattgtggaggtgagttctgcgaggtggctgcttttaaaatgccagtcgtgctgctcgcggaaacagctgtagtatgcggctgcgtttggaccgtaaaaatggatccacagaagctcccaggggtccgcctcactgctgatgtgggtgtattcgccactgcaatctaaaaaaaagcagtcgccggcacgggcagcgacgcgggtcagaggatgtttggcgtcctgggggctgtcggatgcaggaaaaaggtgggagcctgcggtatcccggtaggagacactgccgctgccggagagtacgatcagaaagaggtaggaggagagaccgctccgccggcttaagtgcggccgcagactttttaagtaaccggcctcctggatgtagagaaagttgcttttaataaaagaagaaggggtattgatgacacgtctggtgttggtgacctcggaggtcttatatttttcaaaaaaagagtcccgcatctgtattctcctaatttttgtgtatagcaatataatactatttttgggcaagatattcaatggaaaaaaaacgtggattagattattcttagtaacggctttcaacgcgcatattagcaaaataatcatagaacaaagaaaaaggagaatctagatgagtaaaaaagcattgatcacaggtgtgaccggacaggacggaagctaccttgcagagtttttgttagagaaggggtatgaggtacatggtatggtacgccgttcttccacagagaagagagagcgtatcgaccatttggagagcaacccgaacttccatgtacactacggcgatctgtccgattccatgagcatcatgcgcttagtgggcatgattaagccggatgagatctacaacctggcagcacagagccatgtaggtgtcagctttgatgtgccggaatacacggcagatgtagttgcaactggtgtgctccgcgttttagaggcagtccgtctctgtggtctggagaagacctgccgtatctatcaggcatccacatccgagttatacggaaaggtagaggaagttccgcagcgcgagacgacaccgttccacccgtacagcccgtatgcagtggcaaagcagtatggctactggatcgtaaaggagtaccgcgaagcatacaacatgttctgctgcagcggtatcttgttcaatcatgagtccgagcgccgcggtgagacatttgttaccagaaagatttctctggctgcagcaagaatcgcgcagggcaagcaggacaagctgtatcttggcaatctgtcttccttacgtgactggggttatgcaaaggattatgtagagtgcatgtggctgatcttacagcatgagaagccggaggatttcgtgatcgcgaccggtgtacagcattccgtaagagaattctgtgagtatgcattccgcgaggctggcattgaactggagttccagggagagggcatggatgaggtcggtatcgacaaggcaaccggcaaggtagtcattgaggtatccaaggagttctaccgcccgacggacgttgtcaacctgtggggagatccaaccaaggcaaagaccgagcttggctggaatccgaccaagacaacattcgaggagctggtaaagatcatggtaaagcatgacatggagcttgtggcaaaagaaaactaaaacaaatgtatgacgatacagtatttggcgtgccatggcaggattctgccggggcacgccaagttgtggtaaaaaggagagaaagattatgatggaaaaagatgcaaaaatatacgtggcagggcacagaggaatggttggctcggcgatcgtgcgccagcttgagaaggaaggctatcacaacatcattacccggacacacaaggagttgaacctctgccgccaggatgatgtggaggaattttttgcaaaagagaagccggagtatgtcttccttgcagcggcaaaggttggcggtatcatggcgaacagcgaagctcttgccgattttatgtatgagaatatgacactggagatgaacgtgatccatgaggcatggaaaaatggctgcaagaagctgatgtttctcggatcttcctgcatttacccgcgtatggccccgcagccgatgaaggagagctgtcttctgaccggagaactggagaagaccaacgaggcatatgcactggcaaagatcagcggtttaaagtattgtgagtttttgaataagcagtacggcaccgattatatttctgttatgccgaccaacctctacggaccgaacgataactaccatccggagcacagccatgtccttccggcgctgatccgccgtttccatgaggcgaaggtggcaggagccaaagaagtaacctgctggggaaccggaacgccgctgcgtgagtttttgtatgtggatgatcttgcagatgcttgtgtattcctgatgaacaactacagtggtgatgagacggtcaaccttggaaccggcaaagaacttacaatcaaagaactcacagagcttgttgcaaaagtgatcggttataccggagagatcaagtgggatccgagcaagccggacggaacaccgagaaagcttctcgatgtcagcaagttagagagcctcggctggaaatacaagacggagcttgaggatggaatccgccttgcatacgatgatttcctgaataatccaatgagagccgagcgctagaggggagaaccatatgtatatagtattgttatcgggcggctccggaaagcgtctgtggccattgtccaacgatttatgttccaaacagtatatcaagctgatgaatcatgataatcaaaaggagacggcagaaaagtgttcgatgctgcagcgtgtgtttggccagcttaagaccgcgggactttccgacaacacgatcgtctgcgcgagcagtgcacaggtggagctgattgagagccagcttgacggggctgcagaggtggcagttgagccgatgcgccgtgacactttcccggctgttatgttatcctgtgcttatcttttgtctaaaaagggagcgaaggaggatgacgtcgttgcatttcttccggtcgacccgtacacgacaggagagttttttgaccggatcaagcgtctgggagagtatattgcatccacagagaatacgattggactgctcggcggtgtgccgacgtatccatcaaccaaatacggttatatcgtgccggagaagagtgggcaggagctgcttaaggtcgaaggcttccgtgagaagccggatgaggcaactgcggagaaactggtcgcagacggggcgctctggaactgtggtgtgttttgtttccagttatccatggcagccggctggcttacaaagtatggtgttggcacggattatgaccagatggtcactgattatgagaagcttccgaagaaaagttttgactacgaggtgttagagcactgggagcgcattgttgcgattaaatatgcagatctgtggaaggatctgggtacatggaatacactgaccgaggaaatgccggagaacagcatcggtgatgtgacctgggatgatacctgcgagaacagccatgccatcaatgtgctcggcgtgccgatggttgtgatgggagcgaaaaatatggtgatcgcagcatcccatgatggtattctggtggcggacaagcatcagagctcctatatcaaggattgtctgacgaacattgcggacacttcaaagtatgaggagcgccgctggggtacgatcaagacgatcgacagtgatgaggatgacggcattaagagtgtgacaaggcgcatcaaggttgttgcaggcaagacgacaccggagcacaggcatctgtcccacacagagacaatcacggttctctccggaatgggaaaattgatcttagaaggtgtggaagtagatctgatggcaggagcgacagtcagcattgcagccggcaaacggcatgcaatcaaggctatgggttcggatctgcgctgtattgaggtgtcgatcggtacggacgagaagagtaccttggacgatgagattataggataaggacggcagagcgatgaatatattactgacatccgcgggaagacgcggttatcttgtcgaatacttcaagaaagcactagaggggatcggggaagtgcatgtgggaaacagcacaccggtttccccgagcttttactatgcagatcatgcagttgtgacccctctgatttacgatgaggcatatattccgtttttgctggattactgcaaaaaaaaccacattgatgcggtactgtccttgtttgacgtggatctgtatatgctggcacagcacagggaagagtttgcaaaagaaggcatcaaggtgattgtgtccgcaccggaggtgatccgtatctgcaacgataaatgggagacataccagttctgcaggaaaaacggttttctgacaccgaagacctggctgcatctttcggatgtgaaagctgcactggaggcgggggagatttcctatccggtcatcatcaagccgcgctggggcatgggatcgatcgccatctatcaggcagagaatgcagaggaactcgaggtattgaccaaaaaggtcacgcgggagattttccgctcctatctccggtatgaatcagcgttcgatgaggaggaatgtgtcctgttccaggagatgatccatggacaggagcacggactggatgtgatccacgatctggacggagcatggcagctgacggtcgtgcgtgagaagatcgccatgcgttcgggcgagacggactgtgcgagagtgctgtcggatgagaggattgcatcggtaggaactgctgtcggcaaggcgctgggacatatcggaaatctggatatggatgtgtttgtgaccgaagatgcggtctatgtacttgaactcaacgcgagatttggcgggggatatccgttttcccatctggcaggcgttaatctgccgaaggcgattataaagtggctttcgggtgaggcacttacagatgaacttgtggtaaagaaaacaggtctttatgcacagaaggatatccgaatgatcgatatcacatcgtgtgtaaaagaagacggaaagtaaaagtatggaaaaagaaagaaaatatcaacagtcctatgtgacaccctgctatgagatcaatcttgagcagtttcacgaaaattgtgatgctgtgatgcagccgtttgaaaaagcatgggatggaaatgtggcatacggttactcggtaaagacaaaccatcacgaggcactgatgcgctatgccgcggatcatctgggatggtatattgagacggtttctgtgaatgaatacgagcaggccagacaactggtgcctgcggagcggatcatattcaatggaccgtgcaagcaggaacgtctgctcacagtctatgagcagggaggaatcctgaatctggataaccccacagaagtagaacagctgtgtgagacggtaagaaacggagctgttccatcagaacacacacaggtgggacttcggatcaattttgatctggaggcacagtgcccggatgagacaaccgctggtacagaggtcagtcgttttggcatctgctatgaaaatggtgatcttaagcgtgccatagaccagcttgaggaggcgggtattgccattgacggcatccatctgcacaccagcacaaagaccagaagcacccgtgtttttgcggcattggcggggatggcggtgaagatccgggaggaatatggactgtccttaagttatgtggatatgggaggcggctattttggcggacagaaggtcaccggaaagccgacgatggaagagtacgcggcgtgtatctgtggagaactgagaaaaggtttttcgccggaaaaaacgacgctgatcttagagccgggtgcatccgtgattgcgacgtgtgtcaattatatcagccgtgtcatcggcaccagagatgtgcgtggggtacgtgcagtgacgcttgacggcagcctgctccatatcaatccgtttatgagcagcaggattccatcgtatgaatggctgggagacggggacaggcagatggaggaagtacagatcgtcagcggctgtacctgcatggaaaatgaccgctttttaaaactgatcgagaaaaaacgcatagagacgggggatgtttttgtgttccactatgcgggggcttacacgatggcattcaacagtgagttcatcttgcagccgccgcgcgtctacgtggtaaacgaggatagataaaagttgaaggataaaatgttatcagtaatcattcctgcctacaacgaggaagcgatgattccgatcaccgcaaagtgtgtggcaggattgttggaaaaagaaaaaattgtatacgagctggtctttgtcaacgatggatcccgggatgcaacctgggagaagatccggaaggcttcggacgacaacccatatgtgagggggatctgtttttccaggaattttggaaaagagtcagcgatgatggcagggcttgcctacgcgaaaggtgcggcatgtgtcatcatagactgtgacctgcagcatccgccggagaagatcattgagatgtaccacctgtgggagaacggttacaaagtcgtggagggagtaaaactctcgcgtggcagggagagttttctccataaatgggcggcaggaatgttctatgcgctcatcagtgcggcgacgaagatcgacatgcgcaatgcctcggattttaagctgatggatagagaggtggtggatgccatcttgaagatgccggaaaaacagtttttcttccgggcgatttcttcctgggtgggctttaaaagcacatcggtggagtttgaggtgcaggagcggcagcagggagaatccaagtggtcggtaaaatcgctgatccgctatgcggtcacgaatatcacgtccttttcgtcagttccgctgcagttagtgacatggagcggctttctgtttttcctgttcgcactggtgattgggatccagacgctcgtgcggtttatcatgcacgattcgctggaaggatttacaaccgtcatcatgctccagcttattacgagcagcatcctcatgatcgcagtaggcatcatagggtactatattgcgaagatctatgatgaggtcaaggatcgcccgcgttatatcgtggaggaagagacgggagaaaataagacggatggataggataaaagaactgatgaaaaaataccgtgaactcatcacatatgtgttctggggcgggatgacgacagttgtaaactacatcgtctattttgcgtgcaccaagcttttgggtattgaatatctgatcagcaatgtcatcgcctgggttgtcgcagtcatttttgcattctgggtcaacaaaatctatgtgtttcaatcctatgggcgggacaagaaaacgatgctccatgagtttggtacctttgtatcggcgcgcgtgctctccggtgtcttagagaccggcatgatggcactgtttgtatccgtcatgcattttaatgattcggtcatcaagattattgctagtgtactggttgtcatcatcaactatgtgctcagcaagctggtcatttttaagaaacagaaggaggaacagaaatgaaagtggcattcagtacgccggatgggtttgtgagggaaatctctgcaagaattccaagaccggttaagtctgcatttttcagtgcagtcatcattgggttgatgacacatttatatcagtttaccaataaactttataattatgatgaactgattaatacgccgaatggttatggaaccggagcagaatccgggcgctggtttttgaaaattatcggagattttactggggcacagtttggaaattattccctgccactggtcaacggtatgatatcggtactgttcctcgccgtttcggcggctctcatcactgggatgttccgtgtgcagagtacctttctggcggcagcagtgggtggattttttatttcctttcctgctgttaccagtacgtttttgttcatgtatacggcaccgttttatgctttttctgtattcttaagtgtactggctgcgtttcttatggtgcgtttttcggggaagatcgttttaaatattgtatcggttgtcctgatcgcgtgttcacttggcatttatcaggcatattttgcgaacacgacaagtcttcttgtaatgaatatgattctgctctgtgcgttttccggggaagataagaaatggaaggatatcctttttacagcgatccgctatgtcatcgttctggcggcaggcatgatcctgtattttgtgcttcataaaacgctgctccatgtgtggggactctctatgacttcctatcaggggctggattccatgggacagacgacggtaaaagatcttcttgacggattaaagagctgttatcgggattttatcaatttgttccgtggcgatgtcatgtgcttaaacccgaccaaatatgtaaaaaaatgttattttcttattatggcggcactgggcgtaagtacgctgggacttctgtttggtcagaagggctgcaaggtcaagaaagtatttctggtgttaggttatctggtatttccagtagcggtttatctgatctatctgatgacgccaaacggatgggtctacacactgatggcatacccggctgtttttgtgacgatcttcatggtgatctgggcagaccggtatcaggcggcgtttgatacaaagcagattgcagcgaagggaatgcagtggattgcggcagtaacatcggtcatcatgattggagtgtatatctggtatggcaacggatgttatatgtcacttgagtatacaaagtatcatgatatgtcgtattttcagacgatggtgacacagatcaagagcctggatggctacaatgatgatctggcactggcgctcattgggaatacgatcgatgataacaccaacaatacgggaagtcttgtgagcgggacgtttggacttggtggcaagctggattccaatatcagcgcttactccagaaattacatcatcatcaagtatcttggtttttcgccgcgtttttgcggatatgaggagatcaaggagttgatggaaaatgaggaagtgaaggaaatgccctgctatccggatgatggcgcgattcggatcatagacggtgtggtggttgtcaaactgacggattcataacagcccggcatatctgtacagaaattataagaataggagaaaagatgggtctggaaaaaacgatacagaagaaaaggaaaatcgtatacctggagctgctgcgcatcatcgcgtgcttctgtgtaatcatcaatcataccaacagcgggatttttctgtcgcgcacgccggattctaaaatatggtgggtttcgcttacttacttttttgtcagtaaaacggcggtcccgatctttttgatgatctccggcgtcctgctgctcgggcatgtggatacataccggaaatggtcgtcacgcatgctgcatatttttctggatattctgatattttcatttttttactatgtgtggagtatgtatacagcagaccgatcggtcaacctgattgaatatctgaaactgatctggcaaagaaacgtgaccaatgcatactggtacttatatctgtatttgggaatacttctgatgctgccattgttccagagactttctgtgaacatgggaaagagggagtatgagttgctgattctggtttgtgcagtgtttatgagcacgatgccgatcgtgattcactatatgccgggagcagcgttttcctcttatttctgtgatccgtttttctcggaatttgtgggaattttcttcctgggctattatattcacaattatgtgccggtgaaaaaagaatatgcgctggcagcagtactggtctttggcatggatattttactgcaggtattgctcacttaccgggaatatcaggttgacccacagcagtatctgttttttgacgaacgtacattcattacggtggtcacagcagcggcaacactcttttacctgggacgctgcatggaggcggtgctaaccagtgagtggttctggaaagtggttggattttttggcggatgctcttttggcatttatctgctttctgattttttcctggacagttattatggaatctatggaaacttgtcagaaaggatgaatccgatgatcgctgtgtttttttatgagtgtttgattttcctcacgggagcggcggtcacagcggtcttaaaaaagattccgtatataaaaaagcttctatagacagttttcagtaaagttatgcttgcctttttgctaaaattatgataaaaatggaaaagatacggaagtatcagaaaaaaagattgaatttgatacgaatatggtttatactataaccgtagaaaggggaatgattttatggatacgaacgatatttcagcatgcgaaaagctcgtgatgaaggtcatttgggattctacagaagaattggcattgcaggaagtcatggatggagtcaatcatgagaacggcaagaactggaagccgcagactgtttccacatttttatcccgtctggtaaagaaaggctttctgaatatgtaccgcaagggcagatactgctattatcagccgcttgtcagcaaggaagacttctggcgcgcgacgatggaagagagtgcaaagttctttacgaagggagatctcggagaactggcatgctgtctgtgtgatgacatgctggatgcaaaggacatcgagaaactaaagaaaaagctgaatgaacatagctaatcagattttatttgcagtggtaattacctctgtcacgggaacggcagcgtacggactctggcggctgcttatgaacagccgcttttgtacgaagccgcaatttgtatatctgacgctttttctggtctgcctgttgtacctgattccattggattatggatggatgcagatgacgattcacggttatctgcagaaggaaggtatctggcagatcaatttttctttaacgggatttttatggattcttgcgttctttgctgcagtctgctggcttgccctcatggcaaagggaatcacagagtttgcaggcagccttcgcgggatgaagcggattcagatgcgtgatattccggaggaagagggagccgtgcgggaagagttcgcacgtgtgaagaaaaagcttggcatccggtcgaacatccgtctgtaccggaatgaccgtatcaccagtccgatgtttgccggtattttccggtgccgggtggtgcttccggatattgcctacgacagaaagcatctgagcgtgatctttcatcacgagctgatgcattacaagagccatgacccgtttatcagattatgcggtatgtgtgtgactgcagtgcaccacatcaacccgctgacggggaacctgatggcactgttggacgagtggagcgagatttactgcgatgcacgtgcgattgcagccatcagcgatgaaatggatgcagggtgttattttgaaatgattatagagagtgtgaagcacagtcctgtgaccgatgagaattatattttttctatgctttatgagaaccagagaagactggaaaggagaattgagtatatgggaaaatataatggaaaagcagcatcgagactggcaagtatgtgttttgcggcggcgtttgtgctgatgagtgtgacaccgatctatgcggcgggcagcgaggctgcggacgtacacgatgatatctaccagaatgtggaggctgtgacggcagatggcagcgaggagaacgtgctcgaggagcagcagatcttaggtgtgatggaccgcacttacgataccttggagtatgcgtatccggagcttgaagtcatcagcccgctgctgagcgcgaatgagatggcgtcctttaactggagcgtgtctccgggcacacgtatggtgagcaatcagttctgggtgaccaagggacagacgatccatatggcggcaaccgcgtcaccgtcgagcagcacgttctggatcggcattatggacggactgaacaatgcgcgctacgtggagggatctggcagcctgtctcacgattttgcgatcacgagcagtggacattaccgcgtcttcgtgcagaacaggagcagcgcacagattaacgcggtgggaagttattacttcgattagtatcagcgtaccgcaatcagtgcatagcgatcagcgcatcggaagaggtgcatcggaagatgcgaaagcggtaaagacaacaaaagcaataaaaaagaagaggcattccgcctcttgcttttcagacaaacaaactacatgattagatataattccacggttgcagtgcatttcacattatgattagatcatttcaaggtaacagtattcggggcggtgctaaaatcaagcaccgtctttccttttgcgagcaggtcggatttgagtgtgctcgccggaaagtcggcgttgtcggtgatggaggaaggcgcgtcgataaaatagacggaggcgccggctgcgtcgtagaattcctccgagaaagaccagtttccgtggtggccggtctgcacgtaatcgcaggcgagctggtctttgcatgcggcaagcagggaatcattcatatcgtatttgatgtccgaacaaaagagcatgctgctgtttgcgctgcttacttttaagaggagggaagcattgttctggtaatctttctcatctccgacattctgcagaaccgtgtcgtcataggcatttaggacggagaacgtcagaccgcagatggagaggacgtcgccgcggtgcaggtgcgtcacgttggaggcatcccgggtgagcgtgtggtaggtctccatcactgtaatgtcatcgtacggctctccggccgcttcgataaagtcatagtcaaaaccgttgtcgtagacggcgtcgatcgtgatgccgtctggtgaggcgtagatctgattgaatgcgccggcgtgatcctgatgcggatgtgagagaatccaggcgttgacatggttcccgtgggcggcgatgacctcgcgtacggcggaggcgttgtctgcccagcccccgtcgatgatgatgagggtggtatcgttcgtgatggtgtaaaaggttccctgcacaccggttgcatccgcgtattgcgtcaccagatattccgtggcgggatcgggggtgtagccggtggaatcttttttggattccacgagtgtatgatgggagcatgccgcgagaactacggcaaaaagaacgacaatgacagtggaaaaaaggtgtttaaaacgcatcataaggactcctttgagttgatcggtttattctttgcattctacattaacagagaacaaaaggaatgtaaaggcgtggtaacaacttgacgcaaaacgtcggaattgttatagtggaatacgaaatcaaagagattgaccgaggagtcaatggcgagagaggacggaccatggatacacataaattttttgtggaaaagatgcggttccatctgaaggaacaggacacgctggtctttgtcgggtggttttttgatgggagtacgaaggaacattccatcaaggcatatctggacaacagagagcttccgcttacggtacaggtgaatcgcggtgcggaggtccgacagaaatatatccgcagcatcaatgagatcgaggaggaagtggtaggcatcataaagcttccgccggactggcgcaatggccgccgggtgacattgatggctgcttacagggaagaatataagaaatcttatgccatctcgacagcaaagcttggcagactggagaatgaagtcagctactacgtggaaaactgtcacagggaggggagccagattacggtcactggctggtgcatgtcggcgggggatatcaagcttgaacttctcgacggcagcagacagccgatttccgagaaggtggagcactattaccgcaaggatcttctttctgtttttccggaatgtgataaggaggcaaagcctggctttctggtgcagggaactgcagcgggagggcagagtggtccgttttatctggagatgcggggggcgaagaagcattcgagaaccagactcacgaagtgggacgagggcacaaagctgcagtatgtaatcgaaaaagccggggataccgtccgctatctggagcgcaacggaatctctgcaactgcttataagattaagaacaagctgatgcacaaagagggcaatacctatgagaactggcgggcgaagtatctcccgtcaccggaagaactgcagcgccagagagaggatgtgtttgatgcgggaccgttgttttcgctggtcgtgccgctctataagacgaagccgcagtatctgcgggagatgattgattccgtgacggcgcagacttacggaaactgggagctgtgtatggcgcttgccgcatccggggaagaggatgcagcactgatctccattctggaggagtatgccgggcgtgatgcgcggattcactatcaggtgctgccggagaacggaggaatcgcggaaaatacgaacgccgcgtttgcaatggcttccggagactatcttgtaccggtggatcatgacgatctcgtgccggaaaatgcgctatacgaatttgcgtcggcgatccgcagggatgacgcgattgatatgctctactccgatgaggacaaggtcagcatggacggcagacacttttttgagccgcatttcaaaccggactttgatctggatctgctgtgcagcgtgaattatatctgccacctgctcgcggtgcgaaaagatgtggcggaacgtgcggggagctaccagagcgcgtttgacggcgcgcaggatctggactttatcctaagatgcagcgagcaggccaaaaagatttatcatgtgccaaagattttgtaccattggcgctgtcatatggactcgaccgcttccaatccggagagcaagctctatgcgtttgaggcgggacggcgcgccatcgaggagcattaccgcagactgggaataccggcgcgcgtggaaaatgcatcgttctacggaatgtaccgcacggtctacgagtggaaagaggaacctctggtatctattatcataccaaacaaggatcacgcggaggatttaaagctgtgtctggattccatttttacaaaatccgactaccggaattttgaggttgtgattgtggaaaataacagtaccgagccggagacgtttgcttattataaggaacttgaggcggggcatgaaaatgtcaaggtggtgtactacgagggcggctttaactactcaaagatcaataattttggcgcagcggcatgcaggggagattatttcctgctgctgaacaatgatacggagatgatcgatgggggctgtatccgggagatgctcggatattgtatgagagaggatgtcggaattgtaggtgccaagcttttatatgcggacgatacgatccagcatgccggtgtgattttaggttttggcggcacggcgggacatgctttcattggaaaatccagatacgatacgggatattttggcagaattctgtgcgcgcaggattattccgcggttaccgcagcgtgcatgatgacgaagcgtgaggcgtttgaggcggtcgggggaatgaccgaggaactcgccgtggcgttcaatgatgtggactactgcctgaaagtaagaaagcacggatggctcgtcgtgtacgatccctacgcggaaatgcaccactacgaatcgaagtcgagaggctatgaggattccccggaaaaagtcgagcgctttaacggcgaggtggagattctgctttcgcgttggagagatcagattgagcagggagatccctactacaatccgaatctgacactggacaattctgatttttcgctgcgcagataacgcgggggacggcgaaaacaggtgaataaaacaaaaagacagctggtacgagacagaaaagaggagattccggttctatgatgaaggtatatatatgtccgtcctgcggctggatgcgcgtagtgtccagacgcaaggatgtggaatgctacaagtgcagtgagccgcagatggttcttgcaaaaatggatttcggtaagtacacggaaatgtcagaagaggaaaggaaagattattccgatggatggctttacatccatcagaagaagcattgagcatatgaagattacagtgcagaaggttatcaaaggggtgcgttatctgaagcattacggagtgaaggagtttttcatccggctgcaggagaagatggaagcggaaaatgtgccgtatgagccatggtatgagcatcacaaggcgacggaggagacgctgcgccgtcagcggaagcagtctgctgcgtggaagggagcaccccgcgtcagcatcgtggtgccgctctattgtaccaatgagacattcctgcgggagatgatcggttcggtgcaggtgcagagctacgaaaactgggaactctgtctggcagacggaagcccgaaggaagaggcggtgcgtcttgaggcggttgtgcgggaatgtgccggagaggatgcacgcatctgttaccgcagactggaaaaaaatcttggaattgccggcaataccaatgcggcgattgcaatggcgcacggggagtggattgcacttttagatcatgacgatctgctggcgccggacgcactgtatgagaccgtgcatctgattctgcggggaccgaaggatgagaccggagttgccgcgaccggttttcacaaagccggtgcgcagtatgacatgatctacacggatgaagacaaggtggacatggatggaaaaacgcatttccagccgcactttaagccagacatcaatatcgatctgctccgatccaacaactatatcacgcactttaccatgatgcggaaaacgcttctggagaaagccggcatgatccgtgaggagtatgacggtgcgcaggattacgacctgtttctgcgctgcgtggaatgcgcagaggccatcggacatgtgccgcgggtgctctaccactggcgctgtcacacggaatcgacgtcggaaaacccgttttccaagcagtatgcggtggatgcgggacggcgcgcgctcgaggatcatctgaagcgtcaggggattgcgggggaagtgacggcgacaaaggatatgggcttttacacggtgcgctatccttacagcggcaatccgctggtctcgatcgtgataccgagcagggatgaagtggagacgttaaaaaaatgtcttgcagccattcaaaaaacgcattatgcaaattatgaagtcattgtggtggagaataacagcgctccggagacatttgacttttaccgctcgatcacatccgaagaggtgaaagagggcgaagcggtgtgctatgagggaaccttatccggcggacagcggatctgcgtggcagtctggaaggaagggtttaattattcggcgcttaacaatttcggcgtctctcatgcaaagggcgaatatctggtgcttatgaacaatgacatcgagatgattaccgaagactggctcgaagagatgcttggcacctgccagcgcagggaggtcggtgtcgtgggagcgaagctgtattatccggatgataccgtgcagcatgcgggaatcgttgtcggaatcggcggcaatgcgcgtggcatcgggcagaacatgtttatgggactgcagagagcgcgcagcggatacctgcacaaggcgtcgcttgcgatggattactcggcggtcacggcggcatgcctgatggtaaagcggagtatctacgaggcggtgggcggatttgaggaaaagcttgccgtggcgttcaatgatgtggacttctgtctgaaagtccgcaaagagggttaccttgtggtgtaccagccgcgggtggaagcctatcactacgaatccaaatcgcgcggaagcgaggattccccggaaaaagtggcgcgcttcggacgggagatcgaatatatgcggaatcactggatcggcattttaaagaacggtgatccctactacaatccaaacttttcaacggtatatccgaattatgcgctgagagattatcattaagcggaggtattacatggcgagtcagccggaagttacggtgattattccgaattacaacggaaggaagcttttggaaaattgtatacagaccttagagagacagacctgcacggattttaagcttctggtggtggacaacggatcggacgacggcagtacagaggtgacctccagcctggatcttacgatgcttgcgctaaaggagaatacgggcttctgcggagcggtgaacgagggcatccggcgcgcggatacgccgtatgtgatcctgctcaacaacgacacggaggttctgccggaattcgtggaggagctgctggctgcgatcaaaaaatcggaccgcatcttttccgcgggggcaatgatgattgattatcacgacagagagcgcatcgataatgccggcgactattacacggcattcggatgggcggtggcgcgcggaaaaggaaaaccgctggcggattttaacagaccgtgccgtgtgttttcctgttgcggcggcgctgtcatataccgcaccgggctgctgcgtgaaatggggccgtttgacgagcgccattttgcatatctcgaggatgtcgatatggggtatcgggcaaaaatccacggatacatcaactgctatgcgcccggagcgcgggtgtatcatgtggggagcgctactacaggaacacgttataatgagaaaaaggtgttcctcgcggcgcgcaattcgatgtatctgatctacaagaacatgccatttttacagctgctgatcaacctgccgctgatcctttcaggtattctcatcaagagtctgtttttcctgaaaaaggggtttgcgggagaatatttaaggggaatcggtgccgggattaccgggtgccgcggatgcaaaaaagtgcggttctcatggaaaaatctggggaattacgcgctcatacagctggctttgtggggcaatgtgatccggattctggcaggaagataaatttgatcgtcaaacaaatctttaaaaaatattaagaaaatgttacagaatgtttgcgaaaaaggcgttgtgcttttatggaaattattgtatcattgatgttatatggtagttagaattcgcaaaaggatagcaatatgataaaagacaatcagcagtactttaataagctgcatgtactgatcgatgccttggttatcatcgtatcgtatgtgtttgcatggtggctgaagttcctgagcggtattctggatcatgaagtcggcgtactctcatttgagttctatatgagggcgctgctgctcattgttccggtgtatattttgttgtattatgcgttcaatctgtacacgtccaagcgcgtgcaggggagacggctggagttttccaacattgtgatggcgaatacggttggactgctgctgatgtttgcggctctctttaccctgacgtcttacaatccgcagtatcgcaacttttcacgggagatgcttttctatttctacgtgaccaatattgtgatggaagagattgtccgccttttgatccgcagatttctgcgaagtattcgcagaaggggatacaatttaaagcacattctgctcgtcggctattcaagagcggcagagcagtatatcgacagaattcagcagaatccgcagtggggatacaatgtgcgaggggtattggatgacaatattgccagaggcatctcctataagggagtgaaggtcatcggcagtattggtaatctcaactacatcctgccgcagaacagtctcgatgagattgcaatcaccctcggactggaagaatattataagctggaaaaaatagttgcggagtgtgagaagtccggcgtgcacaccaagttcattccggattacggcaacatcatacctacgagaccttacacggaggatcttctgggtctccccgtgatcaatatccgctatgtgccgctgtccaacacgttcaacgcatttgtgaagcgctgtatggatgtggtgggatcgattgtgtgtatcatcctcttttcaccggtgatgctgctgtcggcaatccttgtcaaggcgacatcgaagggaccgctgatctttgcacaggagagagtggggctgcacaataagccgtttcagatgtacaagttccgcaccatgtatgtgcagacggaggaggaagaacagaaaggctggacgaagaagaacgatccgcgtgtcacaggagtcggaaagttcttgcgcaagacaagcctggacgaattcccacagttatttaatgtgctgaagggcgatatgagtctggtgggaccaagacccgagcgtccgcagtatgtagagaaattccgggaagagatcccgagatatatgatcaagcatcaggtgcgtccgggaatgaccggctgggctcaggtcaacggataccgtggagacacgtcgatccgcaagcgcattgagcatgatctgtactacatcgagaactggacactagggctggatgtcaagattctgttcctcacggttttcaagggatttatcaataaaaatgcatattaggagaaaaatttatgagtagtagtggcaacagcagaaatggggcacatagcagcaacggggcgcacagcagcaaccggacacagacaggcggcagcggacatccgcagaagaagccgctgacaaaagcacagaaggcagcgatccgcaagaagaagcgtcagaagaagattattctcgttgtggttgagatcctggtacttctgcttctggcagttgtattgtttgcggtagtgaagctctccaagatccagaaagatacttctttcaatgagagtgatctggaagttaacgagggaatttcctcagaatcccagcagatcatgaaggggtatacgacgatagcgctgttcggactggacaaccgttccaacggcaacttatccaagggtaacagcgacgtgattatgattgcgagcatcaacaacgatacacatgaggtgaagctggtatctgtgtacagagattcctatctcgacatcggcaacagcacctaccggaaatgtaatgcagcctatgcgaacggcggaccggagcaggcgatctccatgttaaatacgaaccttgatttaaatattacggattatgtgaccgtggactttaatgcggtggtagagtgtgtggatcttctcggcggtgttgagatgaccgtaaccgatgaggaagcggtgctgatgcacggctacatggatgagatctccaagctgaccaagaagaaatccaagtatctgccgggagccggcacctacacaatggatggtgtacaggcatgtgcattcgcgcgtatccgttatacggccggtgatgactataagcgtaccgagcgtcagagagcagtgctcacggcgatgatccagaaggcgcagaaggccgatctcaagacgatcaacagcctgattgacgaggtattcggcgatattaagacaagctacagtaacaccgacctgattgcacttgcatcccaggtattcaattacagccttggcgagacgaccggattcccgtttgagaagaatacggtcacgctcggttccaagggaagtgtggtagtaccgtgtgatctgaaatccaacgtcattcagctgcatcagttcctgtacgatgatacggaatatgagccgacagacacggtaaagagcaacagtgaaaagattatcagtgataccggattccaccagggagatggctattgatgcgtgtagatatcataattccgacttacaaaccggatgacactttttgtctgctcctgcaaaaattgcaggagcagacctttgttatacatgaacttattctggttaataccgaggaagcactgtggaatgaggctgtacggaagtatccgatcgaacagattcggaaggagcttccgttttctagccgcatttttcacatgaccagagagaactttgaccacggcggtgccaggaatatgggagcggggtattccgaagcggatattctgatattcatgacacaggatgcggtgccggcagacgaaaggctggtggaacatctggtgcatgcgctcacatccggtgcgcacggtccggggactccagccaaaggtgcggttgcggtcgcgtatgcaaggcagctcccgcgggaggactgcggcatcatcgagcgctataccagacagtttaattatcccgatgagggatgcgtcaagagccgtgaggacataccgcggcttggcattaagacttttttctgctcggacgtgtgcgctgcataccgcagggatctgtttgagcagctcggcggatttgaatcgccggttatttttaacgaggatatgttttttgcggcgcatgcagtgcaggaaggatacaaggttgcgtatgcggcggacgccgaggtggttcattcgcacaactattcggtgaagcagcagtttcaccgcaattttgatctggcggtgtcccagacggcacatccggagatctttgagcaggtcagctcggaggcggagggcatgcgtctggtgaaaaatacgatgggttatctgtgtaagattcacaagccgtatctgatctggaagttagggtggcagtgtgtcggcaggtacgccggctattttctgggaaaacgctatcagaagcttggcagaagacagatcttgaagtgtaccatgagtccgtattactggaagcggatatggtcagaaaagtagggagcagaaaatgagtaacatactatatatcgtagtaccctgctataatgagcaggaggtacttccggagacatccaaaagactgcgggaaaaagtgcagacattacgtcagggcggcaaaatcgacgcggacagccggattctgtttgtgaatgacggatcgaaagacgcgacgtgggagatgattcagaagcttcacgaggagaattccgtattttccggtgtcaatttatccaggaaccgcggacatcagaatgcgcttctggcagggattgcggtggcggcggaacatgcggatatgatcgtctccatggatgcggatctgcaggacgatgtggatgcgatggaccgcatgatcgatgcctatgaagcgggaaatgatattgtctatggcgtgcggtcttccagacagaaggacacgttttttaagcgcaacacggcacagcttttttaccggatgcttcatttcctgggggcggagatcgtgtacaatcacgcggattaccggctgttaagcagacgtgccgcaaaaggactcctgtcttttgaagaggtgaatctgtttctgcgtggaattgttccaatggtgggctatcagagtacgaccgtaacctatgagcgcggggagcgtttcgcgggggagagcaaatatccgcttggaaaaatggtggcatttgcgctggagggagtgacatcgctctcggtcaagccgatccgcatgattacgatgggcggattgtttgtgtgcctcgtcagcctgggaatgctgattaaggcgtttgtggattacgcgaacggcaatgtggaaccggggtggacaagtgtgattatttccatctgggtgctcggcggtctgcagctgtttgcgattggaattatcggagagtatatcgggaagacgtatatggagacgaaacggcgtccgagatatctgattgaatcggtgcttttggatgcagtagagcaggaagacactcccggcagggaataacggttttgatttcggaataaccggttgtgatttcttttgggcatggaatctgtggaatagagggttttatgagtaaaaaatataaagtgtggattttttgggcattgatgctgatcggggcacttctggtggtaagtcagggcagctattcggatggcgacgatgcctttttttatcagtatacgaacagtatgggatttggagagtatctgtcctggcgctatcagacctgggtgggaagaatgtcgggagaggcgtttgtgtatcttgcgttccggctagggctcggcttctggcgtgtggtaaatgccgtgatgctggtgcttctgccggtgggggtgctgcgcttgtcagaaaaggcggcagggattggtgtacacagtgaggaagcgatcggaccctgcgcagcggcagtgggcggctattttctcatgaacattatgactgtcggctatgcggcggtctgggtgaatggttccatcttctatacctggtgttttacctgcggaatctgggcgctgatgccttttgcggacgcagtgttcgcaaagccgggggaagagcctgcgctgaataagaaatattttctgatcagcataccgtgcgcggtggcaggaacgatgtccatcgagcagatgagcgctgttttgctgacgtttgaggtgttggcggttgtcgcactgttccttcgccataaaaaagtgcatccgcttcttctggttcagacacttacgacagcggtagcgtttgtgattctgttctcggctcccggcaatgagatccgtgtggcaagtgagattgcaaactggatgccggaatacgagacgatgcctttcggacagcatgtgttcatcacgatacactggctgctgtcatcgtttgcaaatgagaacaaactgtttttatgcggcatctgggttgtgggaatccttcttctgctgcagcaggagcagaagaaaaagagagactggatcgctcttgggatcgcggcggtctttaccctggcagcactgcttccttatgcaggctttgatctgttatcggatatggggatgcagtatatcaatattgaagcgtgcgtgtaccaggtgccgtccatggcggtgatgacgcgggaagtgatccttgcgatgatctggtgggctgcggcgctgcttttcaccctgccgtttttatggcgcgtgtcaaaaaagcacatcacgctgatgctcgcctatcttgcgggaatcgcgagtgaggcgattatgtattgctctccgacgatgtatgcgtccggtgcgcgtgtttattatctgacggatcttttatatctgtttattattttgacacttgcattttccctgaaaaagaagcgctggagaaatggattctatgtgggactgctcgtggcgggcgtttggaatctggtgtggcaggtccttttttagacagaaaagaacagaaacatacttttttgatactttcgtcacaattacatcacattttccctgtaaactgcatcatagaaagtgagagagaaaaagaaatactcactggaacagaacaaagagttgtcagggaaaggagcaattattatggataacaatgaatgtaatcataaccagtcttccgattccttctattcatataataacggaacgaatcagaacggcacatcgcagaacaatggagcatacagcgcaaacggagcttaccagaatggcagcgcatacggtcagaacggaggaacctaccagaacggaggaacttaccagaacggaggaacctaccagagcggcacacagaataacagtgcatacggccagaacggaggaacctaccagaacggcggttatcagcaacagttctaccagagccagggagccgggaatgcggcgtacggtcagaatccttccggcaagaaggaaaagaagagaagagaaaagagagagagaaagccgggcggctttggtatgaagcttgcaaaatgtgcggcactggcacttgtcttcgggctggtatccggaacggtgttcgagggcgtacatctcgcatcgggtcagattttcggagactcggattccacggtggcagccacaggcagcgtgctgacacagtccgattccaacaccaagattgaggcgaccggcgcatcatccagctatgtggcatccgatgtctctgacatcgtggaagcggtaatgccttctatcgtatcgatcacgaatgtgagcgaatcccagtatcagagctttttcggcggaacacagacacagcagagcacaagctgcggttccggtattatcgtgagccaggatgcagacaatctttacattgcgaccaacaatcatgtggtggagggtgcagacagcctcacagtcgcattcagtgacaacacaaccgtcagcgcggagatcaagggtaccgatccttccacagatcttgcagttatccgcgttgcgttaagcagcatcgattctgacacattaaatacaatcaaagttgcaacacttggcaattcggatgatctgaaagccggacaggcagcgatcgccatcggtaatgcactcggctatggtcagtctgtgacaaccggtgtcatcagcgcattgaaccgtgaggtaaccgtatccgattccaacagcaacacaaattacaccgcagaactgatccagaccagtgcagcgatcaaccctggtaacagtggcggtgcactgctcaatgcagcaggcgaggtcatcggtatcaactctgtaaaatatgcagacacaagtgttgagggaatcggttatgcgatcccgatcagcacagcaatgccgatcattgaggacctgattacgaaggaaaaggtagatgaggcagacagtgcatatcttggtatcagcggcgtcgatgtcacaagcgatgtggcaaaaacctacaatatgccgaccggtgtctatgtagcacaggtaaaagagaactccgccgcagagcaggctggaattcagaagggcgatattattaccgcatttgacggcaaggatgtctcctcgatggaggatctgtcctctaaacttcagtattacaaagcaggaacgaccgtggatgtcaccatccagagatcttccaacggacagtatgaagagcagacgctctctgtcacactgggaaagaagaactgacagagaaagggctgacacagaggcagtaagtttatgataggagcacttgcagggataagttccaaatgcaacaggcggcggtaaatctgaccgcaaaatccggcatttctaaccacgccgcgcttcgcatctgcgatgatctgtgtctttccaagctttgaacactccgcaggatgtgtccgcaacctgcagacaattttaggattctcgtgtgtcccttgcgtcaccagggaatccgctcattgtctgcggtttgtcggacacatcctgcggagtgtcaaagcgtggcaagagacacagaatgtgatgcaaagtgcggcatggaagaaatactcgaattttgcttcaaagatttaccgccgcctgttgcattttggaaccagacacctgcaagcccgttatgataagccggctgcctctgtgtcagtccctttgatctgtcagtcttctgtctcagtgttccatcttccagaaggctgcagagtaaggcgggagcgtactgccacctccaaagtcgtgcgtctccccggtgagcaggtcaacagctgtgccgcagcttgcgtcgaaatgcgccgtgaagctttcggaatctgcgttgatggcgactagcacacgctcattggcgcttttccgctcaaagatggactgcttattcgtgagcaggacagagcggaaatcgccgtagtttaacgcctcggaagactttttcgcggcgacaaggcggctgatgaaatccgtgagcgtggtccattccggtgcgtcaaagcaggcgcgcaatgcgggatcgccgtcctcttttcgcgctttggcaccccattcacttccgtagtacacgcatggaatgcccggcatgccgaactgcatggcatagattaacggaaggtgcgcctcgtttgagaggatgcttgccacacgggtgacgtcatggttgtcgacgaaggagagcaggtgctttcccttgtacagagtccagttgtccgggccgaactggcgcagcagagagtgattgatctcgaacatgttcatggagttaaaactggaatacagtcctttgtagcactcatagtttgttacggagtgcagcatggtgtcgttcatgatctggttgtaatcgccgtgtacgacctcgccgaccaggaagaaatctggctttaaggtgtcacagtaggcgcgcagccttcggataaaatcatggtcgaggcagtaagccacatccagccgcagtccgtcgatgtcaaactcatctatccagcccttgatgcaggaaaagaggtgtgcgatgacatcctcgttgtgcagattcagctttacgagatcataattcccttcccagccctcataccacagcccgtcgttataattggaattcccgtcaaaactgatatgaaaccagtccttgtagggagagtcccatctcttctctaaaacgtcctggaatgcccagaaaccgcggccgacgtgattgaagacgccgtctaagacgactttgatgccggcggcgtggaggttgtcacacacttccttaaaatccgcgttggtgccaagtcttgtgtcgatctttgtgtaatctctggtattgtagccgtgggtgtccgattcaaagagcggtgaaaaatatacggcgtttgcgccaagcttttgaatatgaggaatccagtcgtttaccttttggatgcggtgggtgagaaccccgtcattttcaaaaggtgcgccgcagaacccaagcggatagatctgataaaatacactttcatatgcccacataatgcgttgcctcctgtgattgcttttttatttcgctgtgctcatgtcgtgtgattttttagagcaggcgcgctgtgcagtgattacggtgtcacgcagaccgccccgttccaatgcggcgacagcctcgatcgtcgttccgcccggagagcacacggcgtctttgagttcgccggggtgcctgccggtctccaataccattttggctgcgccgtagacggactgggcggcaaatttgtaagcctgtgcccgcggcatgccgtcagcaacggcagcgtctgccattgcctcgataaacagatagacataggcaggggaggaaccggacacgcccacaacggcgtcgatgaggctctccggtacgacttctgcttttccaaaggagttgaagatcgcctgcacttcggaaagctcggcttcggtgacatgtgcattgacacacagggcactcatcgcttcgccgacgagggcaggtgtgtttggcatggcgcgaacgagcttgatctctttgccaaacgcctcttcgatggcagcaatggtcttgccagcagcgatggagacgatgatgcagctgctcttcacatgcggggcaatctgcggaatcacctcatcaaatttgttcggcttgacggcgagaaacagaatatcgctgcgctcggcgaccgtctcattggagagtgtcgtctcgatggaaaaccggctgtgaatggcgtcgagtgtctccttggagtgtgcactggcgattacctgccccgtggttaccagggaggcgtttaagatgccgccgatcatggcgctgcccatgttgccggcaccgatgaaaccaatgattttgtcaaacatatcaaaaaccacctttctatgtattgtatgctgataccagaacagccggctaaagatagccggctgtctttctataaaatatggtagcgtttttagaaccaaacgtcaagtcctggtgtacgatgtttagaaatctgtcagattggcagctctcttctcaaggaatgcgcccattccctctttcttgtcatgtgtgtcgttgacaacaccaaagaggtttgcttccatctcaacggcattcttgatgtccatgtcgtagccgttgttgattgctgccttggcaacggagactgcgtagcttcccttggagatgatctttgcagccatagcctttgcggtagccatcagttcttcttttgcgacaaccttatttacaaggccgatgcggtatgcttcgttggcatcgatattgtcacaggtaaagatcatttctttggcacgtcccataccaacaagacgggcaagtctctgggtaccgccgaatccagggataataccaagaccgcactccggctgtccgaaaacagcattgtcggatgcgatacggatatcacacgccatagcaatctcacatccgccgccgagagcaaaaccgttgacagcagcgatggtaacctgacgcatattcattaacttgaaaaatggaacagaagccttgatgccgaatgctcttgcttccggagcggtgaagttcaccatctcggagatatcagcgcctgcaacgaaagacttgaactcgttgcccttcttgtccggaccgccggttaagatgacaaccttgacatcgtccatagcttcgatctcagtcagagccgtgtttaactcgtcaagagtctcactgtttaatgcgttaagagctgccggtctggaaatggaaagaacagcagtctggtcagcgatttccaatttcaaattgttaaattcactcattctaaaaccctcctgaatagtttgataaaaaattaacaaattactaatattagagtacagcgttttctaaaatttgtcaatagaaaacagtattttcatttggaaagaaagggggtataataaatcctaaaatgagtacgttactaaggagtcatacatatgagcacaaagagatcttatctgtcaaaagttgttgtggagatgccggattccggtattaaggattttttcgatattgcaaataccatggacggggctctgtctcttggcgtcggggagccggacttccagacgccggagcatgtcagggaggcggcggtcgcctccatccggcgcgccgagacgaagtacaccgacaaccgcggtaccgtggagctgcgtgcggcggcagcggagtatctggaaaagttcgatctgcactatgaccgggcggatgagatccttattacaatgggtgcaagcgaggggattgatctggcgctgcgtacgctggtggatccgggagacgaagtgctggtggttgaacccgcctatgtgtcctacgttccctgcgtggagctgtgcgggggaattccggtatcgattccgctgcaggcgaagaacggattccgtctgacggcggaggaactggaggaaaagatcacagggcggacaaaagtgcttctcatctcttttccgaataacccgacgggcgccatcatggaaaaggcggatctggaggcgatccgcgaggtggtgctcgcccatgacctctttgtgattacggacgagatctatgcagagctcacctacggcagaaagcatgtgtcgatcgcggcgctgccggatatgtatgagcgctgcgtggttctaaacggtttttcaaaggcgtttgcaatgaccggatggcgtatgggtatcgcggcggggccggcggaggtcattttccatatgaacaagatccatcagttcacgacgatgtcggcggggacgacttcacagtatgcggcattggaagcgttcacgagtccggtgcgggacgaggagatcgatgtgatgcgccaggagtatgacgagagacgtcacctgatggtggacggattccgggcgatgggacttaaggtggttgagccggagggagcgttctatgtgttcccgtcgatcaaagagatcgggctcacctcgatggaattctgcagccggcttttgcaggagcagaaggtggcggtgataccgggagatgcctttggaagctgcggcgagggatacatccggtgttcctatgcgtattccaaggatgtgataaagaaatgtctggaaaaaattgcggcgtttgtggcgcagtttgacctggatttaaacgcttgacagtagagacggagaagagaatgctggataattatcatctgaaccagttggcagagcctctgcttgcgtggtttgtagatcacgcgcgggtgctcccgtggcgtgagagaccggagccttaccgcgtgtgggtctcggaaatcatgctgcagcagaccagagtggaggcagtaaagccgtattatgagcgctttttaaaagcattgccggatgtggcggcgcttgcagcctgtccggaggatcaattgatgaagctctgggaggggcttggttattacaaccgcgtgagaaatatgcagaaagccgcagtcaccgtgacggaggagtatgatggagtgcttccggcggattatgggaagcttctggaattgaaagggatcggttcctacacagcgggtgccatcgcatcgatcgcctatgggataccggtgcctgcggtagacggaaatgtgctgcggatcttgacgcgtgtggcggcggacgataccgacatcatgaaacagtcgttccgcagtgcggtggaagcgcagctgggagagatgatgcgggaacttacggttcctgaggagcttcggcgtgtccttcgcgatgaaaatgttcccggcgcgctcaaccaggcgatgatggagcttggggcgacagtctgtgtgccgaacggcgcacctctctgtgaggaatgtccgtggagtaagatgtgtcttgcgagagcacaggggcgcatgatggattttccggtaaaaagcaaggcgaaggcacggcggattgaggagcgcacggtgcttgtcattcgggatggagaaaaggtggcaatccgcaagcgcccgaagaaggggctgctcgccgggctgtatgaactgccgaatctgtccggcgcattgagcgccaaggaagttctttcctatgtaaaagaacagcagtttgctccgctgcgaatcgagaagcttgcggatgcaaagcacatattttcccatatcgagtggaggatgagtggatatgccattctggtggaggaagccggctttgccgcagaaaaggaaccagagtcaggaaatgggcgcaccccggaagagaaagcggacggggaaggcggactgatttttgtggatgcatgggatgcgagagagcgttatgccattccgtcggcattttcagcatatgcgggttatttaaaaaaggaatttgattaagatcaagaaagataaaaaagtttgtaaaaaagagggagccggtgcattgcaccggcttttcatatgaaaaagattgtgtgtatggaaagtgaaataaattcactatctgctgggaggaaccttgcctatttctaagcaaggtgacctgacaagcacttgtcaggaatgaaaaagttctatgaaaaatttaacttgctgtcttaactttatctatactataaaatggaaatatgaccagcgtatgccaagtttattagtattttgtaaataaaatatgaacaaatgaaggaagtggacatttttcagtggatattttgaaaaccttaaggaaaaaataaattggcgtactgtggaaaatcctgtataatgaaacaggtcaatgttaagacaatgcgggcagtaccgcagaacggaggagacatgtacgattgtattgtcattggagccggaattgccggagcggtggcagcgcgaaagctggcagaggaaaaaggaaagcgtgtccttgtcatggaacgccgaccgcatatcgggggaaactgttacgatgagaaagatgcccacggcattttaattcataattacggaccgcatatttttcacacaggtctggaggaagtgtttgcatatttatcgcgttttacggactggtacctgttcgggcacgaggtggtcgcaaaggtcggggatcagctgattccggtgccgtttaacttaaatacgttacatatggtatacgggaaggagaaagccgaccggctggagcaaaagctgatcgaaacctacggcgagggttcgcgtgtgccgatcatgaagctgcgcgagaacgaggatgcggatatccgcgagattgcacagtatgtgtatgagaatgtatttttatattacacgatgaagcagtggggtcagaagccggaggagatcagcccggaggtcacagggcgcgtcccggtgttaatctcctatgataaccgctattttcaggataagtaccagggagtgccggcgaacggatttacagaaatgtttgagaagatgctttcccatccggggatcacggtggagtgcggcacggactgcttaagccgcatgcgctttgcggacaatgagatttattttgacggcgaaaaattcgacggcgacgtgatctacaccggcgcgctggatgaattgtttgcatgcaggtatggaagactgccgtaccgctcgctggatttccggtttgagcattacgacggggcgtcttaccagggacacagtgtggtcaactacacggtgagcgaggattttacccgtatcacggaattcaagtttttgaccgggcagagggatacggacggcaccacgatcgtgaaggagtatccgtttgcgtatacgggagcagagggagagattccgtactatgcgattttgaatgaggaaaatcaggcgctgtacgaaaaataccgggcactcacggctggcatggagcattttcatctgctcggacggctggcggagtaccgctattacaacatcgacgcgatggtgaagcgcgccatggaactggcagacagattgtaagagtgtgacggaaaatctgccttttgggaagaaagccgggttttcttttacggaaataaaggagagattagaaaatgaaattgttgacatttgcgattccgtgctacaattcggaagcatatatggaaaagtgtatcgagtcgctgcttccgggcggggatgatgtggagattttgatcgtggatgacggatcgcatgaccgcacggcagagattgcggatgcgtatgagaaaaagtatccggggattatccgggcgattcatcaggagaacggcggccacggcgaggcggtcaatgcgggtatccgcaatgccaccgggctttattttaaggtagtggacagtgatgactgggtggatctggatgcttaccgcaagattctggataagttacgggagatttccggcggtgacagagtgctggatatgtttattgctaattatgtatatgagaaagagggagtgaagcataagaaggtcatgcgctgctccaatcttccgaaagaccggatatttacctggaaggaagccggacattttcacaagggacagtatattctcatgcattccgtgatctaccgcacgaagcttctggtggagtgtggactggaactgccgaagcacaccttctatgtggataacatctatgtatacaagccgcttccgagtgtgcggacgctctattatatggatgtggatttttaccggtattttatcggaagagacgatcagtccgtcaatgagagagtgatgatttcccgcattgatcagcagatccgtgtgaataagattatggtcgatgcgtttgacctgtggaaaattccgaaccggaagctcagacattatatgttcaactacctggagatcatcacagtcatctcgacgatcatgctgatccgctccggcacggaggagaatctggagaagaagagagaactctggaaatatattagagaaaaagatatccgcctgttccatcatctgcgggctggaatcctcggcaatacgatgaatctgccgggaaaaggcggaagaaagatctccgttgcggcatataagctttcacagaaggtggtcggcttcaactagcgggaatccctgctctgtgtccgggagagatttttgaggaaatacatgatcttaaagttccagatgtaaccggcagcaacattctaagcgcaaaatccggtatttctaaccacaccgcgtccggcatctttgatgatccgtgtctttccaagctttgagcactccgcaggatgtgtccgcaagccggcagacaattttaggacttttgtgtggcgcttattcgccccagacaacagctggcataaatgccacctttatgtcgaacaaaacataaccgcgcgaagccgatgtttgaattggcatctgcattattttcaatagcagatgccaacgagtttcggttcgcgcggttttatattgtctgtgaagaagtggcattagcgccactaaaaagtccgctcattgtctgcgggttgtcggacacgccctgtggattgtcaaagcgtggcaaagacacagaattggataccggacgcggcatggaagaaacactcgaattttgcttcaaagaatgttgctgccggttacattctggaactttatgcacacgcattgaatgaaatatactcttccagatacagagcagggattccctgcgattaagaatccatactcatctcgtttaagagggctgttttcatatcgtagagcttctgggacagatcgacatagatctcctgcgggttgacgaaacgcttggtctcatcccagatggtgtctttttcatggttacagatttcacggatctccatgacgctcggggaagtgtagacagtttttccgttctttattactggaatcagcatctcgcgcagagtgtagcttccgcccggaagtctcgtctttttccagggagcgttcggatcaaacagctttaagtcttcgctctcgtcgaatgtctcatcgtacaggcagatgagatcggccttgatcttgccggtctttttgtcatagacgcggtaaaatgtcttgttgccgggatttgtgactttttctacattctcagataacttgatcttcggctggaaacttccgtctgcagtgcggatggcggcaagcttgtaaacaccgccgaaggcagggttgtctttcgaggtaatcagatttgtgccgacaccccaggagctgatggttgcgccctgcaattttaagctttcgatcaggtattcgtcaaggtcgttggaagcggagatcacggcgtccggaaaaccggcttcatctaacattttgcgcacctgcttggagaggtaggcaaggtcgccgctgtccatgcggattccgtaataagtcagcggaataccggcatcgcgcatctcggtgaagacacggatggcattcggaataccggattttaacgtgtcgtaggtatccacgagcagaatacatgcggacgggtagagctcagcatatttgcggaaagccgtgtactcatccggaaaactcatgatccagctgtgggcatgtgtgccgagtaccggcacatggaacatctgaccggcgagaacattggaagtgccgttgcagccgccgattacggcagctctggcaccgtaggtaccggaatccggaccttgtgcgcgccgtaaaccaaactccatgacattatcgcccttggccgcgtaacagacgcgggcggccttggtcgcgatcagacactggtggttgacgatatttaagatggcagtctcgattaactgtgcctccatgatgggagcgacaacttttaccagaggttctctcgggaagatcaggctgccttccgggacggcgtagatgtcgccggaaaatttgaaattgctcaggtattccagaaaatcttcgtcaaatattttcagactgcgcagatagttgatgtcgtccgcgtcaaaatgcagattctcgatgtagtcgatgacctgcgctaaacctgcgcagacggaataaccgccgtcgcagggattgttgcggtagaaggcgtcaaagacgacaacatcctgattatgatttttaaaatatccctgcatcatggtcagctcatagagatctgtgagcagggtaaggttcaatgtactcatgtgtgtctggaaccaaagttccgctcctttcctgttttgagattggaactattataacataatcgttgagaaaatgtaggaaaagttatatagttaaggtattctgaaagaaatgtgaggcagggaatgggatgagaagagagcgtgcgatggcactgtttgaagaaggatataattgtgcgcagtcggtatttctggcgttttcggatttacatggaatggatacgcacacggcggcggcactcagctcgtctttcggcggcggaatgggaagactgcgcgaggtgtgcggagcggtcagcgggatgtttcttacggtgggcatattatacggctatgacgacccgggcgcccgggaggaaaaagcggcacactatgcgagaatccaggaactggcgaaggcgtttgaggaaaaaaacggttcgattgtctgtcgggaactgcttggtttatcggtaaagcgggaagaaccgacaccgaaggaacggactgccgagtattataaaaagcgcccctgcaaggaacttgtcggggatgccgctgagatattggaaaagtatattgcagaacatccggtggatgagaggttagaaaagagaggaacagtcagatgatgattcgcagagcagccatacaggatctggaacagatcatgcagatatatgcgagggcggtgcagtatatgcacgcgtccggcaaccccaaccagtgggtggaggggtatccgtccagagcgttgattgaggaggacatcgcacgcggagtcagttatgtagttgacagggatggcgtgattgaggctgtgttttcctatatagaaggggaggatccgacctaccggcagattgggcaggggatgtggcgcacgaatggaagttatggaaccgtgcaccggctggcatccgccggacggctccgcggcgtggcgggaatctgcttttcctggtgtgccgagcaggcaaaaatgcatggctgcagcagtcttagggctgacacgcatcaggacaaccgcattatgcagcatcttctgcaaaaaaacggatttgtgtactgcggggtgattcatctggcaaacggcgcgccgcgtctggcgtttgagcgggctgccgtggcgccggaaggagtaaatccgggaatgccgcagcagaaacagaaaggggacggcagaggatatggcattgcatcgctcatacttggaatcgtgtctgtgctgctgttttgtacctgcatcaactgggtgacgggaattctggcgattattttcggaatcattcagatcacgaaaaataaggagcatggtcttgcaatcggtggaatcatcacagcggcgatctcaatggtgctttctgtcgttttatatcttgccatgtggttcggaatgacaaatgcggggattacatacgaagatctcctatacgatcagtatgatgacagctatgacagcgatggaagtgatgcatggtacgacggcgatggaaatggcagttatgatggcggcggaaacgacggatggtatgacgacggcggaaacgacggatggtatgacggtggcggaaacgacggatggtatgacggtgatggcagtggcggctacgattactataatgatccctacgattatttcagagattactatgacgttcaggagccgggcggcaatcagtttatgtgagtgttttcggcaatgaagtgatagcatcgcgcttttcggaatatactctaagtgacagagcataaaggtcagagtagaagtgcggatagcaggaagctggttttataataaaaagaaaagaggcagactgatctgggtgacagcaggaatggcatgtatggcggcggggtgttgtgtagctttttgcatgcaggtatccctgcgtgcgccaacagaggtcagggagacgatggcgatgaatgaatcggtaaaaaaagtggcaattacattcgacgacggacctaatccggactatacggagatgcttctttcggggctgaaggaacgtggtgtgaacgccacgttttttctgttgggaaaagaagtggagcagtatccggagatcgtgaagaaaatccatgagggcggacatctgatcgggacacactcctatgaacatgtcaatctgagcaatctgaccgatgcagcggcgatcgagcaggtggataagacgaacgcggcgattcatgcaattatcggtgagttcccggagtatatccggccgccgttcgggtgctggaaaccgaatctggattatgagacgacaatgattgaggtactctgggatgtcgatccgaaagactgggcgacgagcaactcatcggtcattgcgcagcgcgtgctgggggatgtcgaggagaatgatattattctgcttcatgatgcgtcggagtcgtccgtgctggccgcgtttaagatcatcgatgaattgaagacgcaggggtatacatttgtgacggtggaggagattctgctggagtgagacgcgaaagtgcagcgcgggcaaagtttgtccgcgctgtttatctaaatggaaaatattattttatatgatactaaaattgcgagaaaaaatcacctgatgcgcattgaaaatagggggaaatggtgataatataatatattatatgaaattgaagagaaaaaatcgaaggagagatattttatgatatgtcaatttacatttgaaaattataaagcattttcaaaagaagcaatgcttgattttactgcggagagaataaatgagcatgaaagcagtttgctgattgatgaaagtgccggggagcgacttgtgcctgttatagctatttacggacctaatggaggtggtaaatcgacagtattggaggctttaaattttttgagagacactatattgcgggttatagtgctgacaaaactgcacgatgaggaggaaaagtatgaaaatgttatacgaaggttatcttcgacagggtcgaaagaaatatactataagctttctccggagtacaaggatttacctacaaaatttgacattatgtttttggcaaaaggcagtaaatggcactatcagctcgcgataataaagaatagaattatatctgaaaatttatatgcacaaaaagcgggaacaaatgacgtgcggcttatatttgaacgatcggatgaggaatgcattctgggtgaggaaatagaagatattgcggttgaaaaagtaaatgatactatgcccttactttcacatattgctattaattatgatatagaaagtattgatacggttgtaaattggttctttgatattaaagtgcttaattatgataaccctcgtaatgagaagaaaatattattaccaaaaacaaaagagaaaagaaaatggttatttaagatgttggaagaaatggatatagcaattaaggatatccgcattgtaaaagatatagatggtaacatagaagatgtatatacgaaacatgtaatggaaaatggtaaaatgtgtgagatcagtctggatgaagagtctagcggtacgagaaagctgcttagctgtcttggaaccataaacaggtgtctggaagagggaaatttgatgattgctgatgaacttgatgctaaactacatccgaaattgctgcggtatataatagaattatttacaaatccggaaagcaataaaaatggggcacagctcttattaacttcacatgatattacgacgatgaatcatgatgtatttcgtagagatgaaatatggttttgtgcaaagaatccgtatggggcatcaaaattatattcacttgtagcatttcgaaaaacagatggaagcatgataagaaatgatgaagcatatggcaaacgataccttgagggacgttatggtgccgacccatatatacgaaaaattataaattgggaggattgcgaatgagtcttaaacctaagaaatttagtgaacttaagatacaacaagatgaactccagaaaaaaatgcaaaagaagaaaaagaaaacgaacatagtattgccgccgtatacttatattgtaagtgaagggacaaaaacggaaccatattatattgaagcgatggcacaggtaataaatgaaaaatatagagagttttcaacgggcaagtttgtggtagtagagggaacgggcagaaacacaaaaggattattagagtatgcaagagcaaatgttgccagaaattttcctcaagcggaggttgtatggctcatgtatgataaagatgatttcccgttggataattttgacaatacacaatacagtgcagaaggcaagaaagatgtgcgcgaataccgggtagcgtggtcaaatgagtgtattgagttatggttccttcttcattttcaggaactgtctgttaatgtgggaagagaaaaatacagagaattgctaaagggttattgtcaatatgagaaaaatatgaagtcaatttatgatgtacttcgagataaaacacccattgctatagcacgggctaagcgtcaatatgaagcatatggagatactgcaccatctcaaagatgcccggcgacaagagtttatcagctggttgaagaattgcagaactacatttagcctgtaagagattctgactataataagattattttaggatagatattaagaggatctatgaagaaaaaatggattgccgttataacggctgtatgcatgataagtttgtttggctgcctgcattatctacatgaaatgcaggaagaaaagtatacagtcataacttctgtaaatggtgtggaatttgatgtgccgaaaaattatttgacgcaggctacagctattacaggtatttcagacgatgaggattacggtacatatacgtatgtatatagtgacgggaaaagtacctatttattatttgatatggatcagattataatgattgttgacaatcagacggattacggattacagaattctacaaacataggggaaacaattactgaaaagccaatagatggtgtctggtttaatttggaagataaagcagaccaatatgacatgaaaatcaaaaatgatgcgtatcggttaattcataccgtacgaagtgacgtatcagtaacagaaaatcagggtggtacgtttgtgggaaaatttgcaaatgtatctgttagtggggtggaatgctccatgtttgtaggcgcaagaggagaatgttattctgagttggattttgacacgaaaagaatgcttgaacatatcgcaaagtctttgaacattacagatcacacagcattgtctaatgttgatataaatacagatttgcctgtgtcaggcaggaagggaaaacttgatatagcggataatcagggagagatcggaaataaatattctgatatctatcatttgttagctgttggtatgacaggaacttatttggcgtatgataaaaattcagaattctctttatcaagtggggaaatcacagttgagcagttatacacaggagaggatgccatagatatcataaaagcgtattgcaattcgggaaaatctatgcggaaatatatggaagcaccagaaggattctcttggcatgttataaaatacagtctatcgcagtctcagaaagacttatatacaaatattaaaattgagggtctggatggaaacagactggtttatcatggtgtttcatgtacgagtaggacatatgatattatatacgattggaataagaaaaatgacctgtattgctattacgcagtaccaaatggatgcaaagaatacatgctggagtgtggaaacaggtataagtctacatcagagaccgcctgttatcgtataaacatagtgaattcagagtaataggaaaaatacaaatgcaggttgactttttgctatattacatatattatacaaatgtaactgtgatatgtgttaataatactctaggttgtacatctctcagtatctgagaatgatcgaaccctagagtttttcatttaaaacaagtaaatattttgagtaactttttattatagattatagaatgtagtttgcgtattagagacataacctgtataactctacaatcaaataactggaaacgtatgcatggcgtaccattaaaggcaaaacctcgcagtttgaatggcaacttgcttgcacttattaagttaaatgatcgttatgtgtcaagtcgaagcccgaaaaaaaggaaaaaagctcgtttcagagggacttttaatgtttttgcaatccagcagaaccccgaataccggctttatcacagatatgggtaccagaaagagaaatacaggcgcaaggtaaaacgcgcatacaataagtaagaggaggattgttttatgaaatatttttcaagaaaaagaaaaccaaaacgcttttatgtacttgtcggcttatttacagcaatgacattgactgcgtgggctaacttcacctacatcgaccacaaggctgaattgactctggaggcgggaagtaaagacgatcaggtagattccttcattagttggggagaatacggcgtagtgaatgaaatggtgctggcaggcggtgtaacatctggaaaagcacaggagattttaaattctggctactgtcttcagtatatggattcatggaaagctgccggaaaaattccgtcggacttcacacctgcatcccagaagagcagctcatcaagcagcacttccagcaatgatacacaggcaacagcaaccgacaacagcggatctgattccaagaaaagtgacaccaattccaccaagacttatacagacgcggagatcgacgcggcatggaaagcagtcacaacagtagatccgacgtgcgcaacggacggttacacagaatataagaacagtcttacaggaaaaaccaagcaggaagcaatcccggcgaccggtaagcatacctacgaggtaacggacagcacggatgccacctgtatcgaagctggcagtgtaacatacacctgctctgtctgcggggacacttacaccgaagagacagatctggcggaacatacctacgaggtaacggaaacaacggatgccacctgcaccgaggacggaagcacgacatacacctgttctgtctgtggggacacgtacgaagagacgattccggcgaccggacacgatgacggcgaatggacagtaaccaagagtgccggagcattttcaaccggaaccaaggagttgcgctgcaccgtctgcggggaagtgcttgacacagaaaccattccgcagacctgcccgatcccgttatttggcgttgtagccattgttgtgatcgcgggcggcgtgattggtagaacgattagcgtagtaagaaaagcaaagaaaaacaaggcagattaactgccttgtttttctataaagcattccggaagattgcgctaagattgaacagttctttggagataacatcatttacagaaatatatggggtatcccaaaaacgtgaatcaaaagacagctcccgattatctcccatgacaaagagacattgagaaggaacaacaaatgtatcggtacagttcgtctcaacatcttccggcagataggcactctcatcgagctgtttgtcgttgatgtatacataaccatcataaaaagtaattttatctccggccactcctataacgcgtttacaataggtggttccattaagatgaaaaaataaaatatctccggcttgtggttcactggcaatataggcaagacggttaccgatgacgatatcgcctgtccttaatgtggcttccatagatccgcttttgattgaaccgatagagagtatgctgtttaacagaaaaattataatgctaatgcatataaggtatggaagaaactcacgcaaatataagacgatggatgcgaaaggctggtgtagtttttttgaaaaattgttctcacaattcaagatagttcctccgatatggtatgaaataagtagccattagttcataatcatgaatgtctgttacttacgttgcaggtgttgtggcttgaccagagttatttactgatgcatcagtgtttatggggtatcactatctgttgttggtgcggattgctttatggagttcgcgagagcagcagtagttttttcatcatatgaagtttccaccgagccatcccaataacatatggtggttgctttaataccatttttgtaagttataatttcgatttcgctccaatcggttgtcccttgtacgccgtctattacggtccagtctgctatttcggattcatctgcagaatctgtctctatttgtaagtgtgttgcaatatcattactctcaaaagcttttttataattttcgatgagagataaatcttttaccggcgtttctactggatcagttgtttcgatttcaaaattcatgagggctttatattcttcgtctgtaaaaatatttttcgcactttcttcaaatgtcacttcatctaccggattattttcaacgtaataattttctgtataagaatcctgaaatcccatttcatataatggataatcactcttgtaagacaacaataatttacgttctccattctcaatggtacatacatcaatctcatttccataggaagactcctgtaatcccagataatatggagttccctccaggttatagaggaaaaggctggttgccgatgcactacagtccaccaattttacagttccattataataagtatataaatcatatctccagtcggcgcatccgggaaataaaaataactctggaattccatccaaatttacatcgactattccatacgtggcagcatcagcatcttgaatttgcagcccctgattacttgcatccggtaatattgcacccgactgaagaaaatctatgtaagcctgcttccaatcctctgcattattaggtgtttcacttgattcttcctgcgtaacgattgtttctgttgcgctttcttcttgtacggttgattcagtagatgacgttacctgatctgtctcagttacttcgttttcctttacaggttcatttttctgagaatcacacgctgaaagtgatagacctattgtcattaccaatactgatattaacactttttgtttgttcatattctttttcatatgtaattcaaaacctccattatgatttactatattgtatcatacttaagatgtaaaggataaaaaacattttatgacagcgttagaattagatttacagattcacttgcaaccctccgatcaatttgttacagtatagaaaatgatttccggggaaaatcgtgcacaacagagaaaatgcatatttttacttgtaaaaagggcatatatcgtgtattgtaatagaagtgatgcaattttgatgttgcaatctgtcatattttttggaaaaatcatgattaaaaccacgaatcattaaaaaaatgcaagttttacataaagaaaattcaaaacggtcaagtgtacgctgcgcacggacatacgccggaaggcagtgaccgggaatttttatacatcagaaagcaggttttgacatggacttatttgaatatatgagagaacaacaaaaggaaacggaggcgccgcttgcatccagacttcgccccacgacgttggatgagatggtggggcagcagcatattataggaaaagataagctgctgtaccgtgcaatcaaagcggataagctaagttccatcatactgtacggtccgccgggaaccggtaagacgacgcttgcaaaagtcatcgcgcatacgacgagcgcagagtttttacagatcaatgcgacttctgccggcaagaaggacatggaggaagtgatcgcgcaggcgaagaacaaccagggaatgtacggcaggaagacgatcctctttatcgatgagattcatcgcttcaataaggggcagcaggattatctgcttccgttcgtggaggacggcacgatcattctgatcggtgcaacgacagagaatccgtattttgaggtcaacggagctttgttgtccagatctatcatttttgaactgaagagtctgtcgaaggaggatatccggacattgattctccgcgcggtaaccgaccgggaaaagggactgggcgcttataatgctgtgattgatgacgatgcgctggaatttctggcggatgttgcgaacggggatgcccgcgcggcactcacggcgatcgaactcggcgtgctgacgacggagcggagtgcagacgggaagattcacatcacgcttgcggttgccagtgaatgtatccagaagcgcgtggtcaaatacgacaagtccggggataaccattacgacacgatctccgcttttatcaaaagtatgcggggttccgatccggatgcggcagtctactatcttgcgcggatgctgtatgcgggagaggacatcaagtttatagcaaggcgcatcatgatctgtgcggcggaggacgtcagcaatgcagatccgatggcgcttgtggtcgccacatcggcggcacaggcggtggagcgcatcggtatgccggaggcgcagatcattttagcgcaggcggtgacctatgtggcgagcgcaccaaagagcaattctgcggtctgtgccatcagcgatgccatggcggcggtgcgggataccatgacggcaccgataccggtgcacctgcaggatgcacattataagtcatcacagaagctgggacacggcgtcggttacaaatacgcgcatgattatccgaatcattatgtgaagcagcagtatctgccggacggtctgacagaccgcatgttttatcatccgtcggagaacggctatgagaaaacaatccgggaatattttgaaaaaataaaagggatgcagccttagaaataaggttcatataaaatgtatatacagatagcaggaggaaggaacaatgcagtcatatcaggagatgagcaaagaggaactgttaaaagagaaggaacatctggaagcagaatacaagaagttccagcagcggggattgaagcttgacatgtccagaggaaagccatcccaggaacagctggatctgtctatgggcatgatggatgttctctcgtcctattccgatctcgcatgcgaggatggaacggactgccgcaactacggtgtactggacggaatccaggaggcgaaagtgctgattggcgatatgatcgagtgcaatccggaaaatatcattatctacggcaattccagcttaaatatcatgtacgatacgatttcacgctccatgacacacggtgtgatgggaaatacgccgtggtgcaagcttgacaaggtgaagttcttatgtccggttccgggctatgacagacattttgccatcacggaatattttggcattgagatgatcaatgttccaatgcttccgacaggaccggatatggatatggtggaggagcttgtcagcaaggatgaggcgatcaaaggaatctggtgtgtgccgaaatactccaatccgcagggaattacctactcggatgagacggtacgccgttttgccagattaaaaccggcggcaaaagacttccgtatttactgggataacgcttactgtgtacatcatttatatgatatggatcaggatcatctgatcgagattctggcagagtgcaagcgcgcgggcaatccggatatggtatacaagttctgctcgaccagcaagatcagcttcccgggttccggtctggctgcgattgcaacttccgcgaacaatctggaggatattaagaaacagttgaagatccagacgatcggtcatgataaggtgaatcagcttcgccatgtgcgcttctttaaagatgtgcacggtatcacggagcacatgagaaagcatgcggcttccctcagaccgaagtttgagatgattctggacacattcgacaaggagttaaaggatctcggcgtcggaagctggtacagcccgaaggggggatattttatcacctatgagacgctggagggatgcgcgaagagcgtggtagataaggcgaaaaaggcaggcgttgtgatgacaccggcaggagcaccgttcccgtacggcaaggacccgaaagattccgtcatccgtatatctccgtcgtatccgtcgctggaggatcttacaacggcaacacagatttttgtagtctgcgtaaagctggcaagcattgagaagattctgggggaacagcaggcgtaagagcacagagcagggaatgatatgaaaaaaataattggaatagtgacaccgattcttctgctgattttaccgtatctgctttttgtggttctgtctgtgggcatgggaagaccggacagagattcgtctggagcctatatcatggcgggcgattccagattgcagatgacgcagacggcaatctgcattgtctacacggtggtcgtgctcttaaatgtcgtctgggtcatctatcagacggcggcaggaaccggcgcgcaggcgctgcttctgtgggatatgctgatgaagctgtgctatgtcccgtattatctgctggcggcgtttatggtgctggcgggatttgcgacgtttatgtttggcggagtcgcgattatcggcgtgatgtggattgcggatgtcctgtttttgataccgccgtccatctacggactgtgcggctgcatccgggcgtgcagtgaaaaaaagctgtccgtgggggtagcagttgccctgtcgatactgcactttatctttgtgctggacgttgtggcggcggtcgtcggattctgtaccgtacacggcagacacaaacgtcagaaacagatggaggctgccagacagccgcagatgacgtaccggaattgaacaagtgaatgcaaaacataaccgcgcgaaccgaactcgttatcatctgctattgaaaacagggcagatgataactcagacatcggcttcgcgcggttatgttttgtttgacataaagatggcatttcgccatctgttgtctgggtgccaacaaggggcacacacaaaagtcctaaaattgtctgcagcttgtggacacactacgtggaatgttccaaacttggaaaaacaaagatgttcaaggatgtttgacgcggcatggttagaaataccggactttgcgattagaattgccgccccggttgcatttggaacgtcatacatctctattacttataagaaaacgtatcccgttctaaatttggattatgcctgcgtctgggcagcctccgtctcctcggttccgttcttccacttgttgaacttctccacaacggcatcgtaggtgcgctgtgagatgtccggaagatcctgtccccaggacttggttgcttccttgaagcccttcttgaaagcgtcaagaagaagatcagctttttccggatcgttgccggagagtgcttttgcaaaatcaagaatacggtctgaagtctggtcgacgccccagtaaccgtcatcagcgatatctgcctgcgcctgtgccctggtggcttcatctacggtaaaatcaccttttgcaaggaagctccacatagaatctgcggtaccgatggcaacaccctgcttggtcatcatcttttctacaagactgcgaagctgggaggtacgctgctcggcatctgcctttaacttgttgacaagtgcgtaatcggttttctttgtaaccgtgccggatgtctgaccggaactcttctcatatacgacaccggtatcggtctttgtgctgctctcactctttttctctgtatggtccgtctttgctgcggtataagtagaagcccgctgtgctgccactgagtttgtaatactgttaattgccataattcattcctccattcccttggatcggtttaaaataattgacaggaggcatccatgcctgctctttgtctcatcttctatatcggcaggaaacattgcccggtttagatttttgagaaattttattgcgtaaaaagaaggagagataattgaccttttttacaagtcatggtaagattcagtctgtatacaaaatacattaaaaaaacatgggggcattatgaaagagatttcggtaaaagcactggcaaaagtaaatctcggacttgatgtggtacggaagagaccggacgggtaccatgaggtgcggatgatcatgcagacgattcatctgtttgaccggctggagattacccgcaatcagtcgggcaggattacgatgtcgaccaaccttgcgtttctgccgacaaatgagaacaatctggtatacaaggcggcagcacttctcaaagaggaatttgacattggggacggtattgatgtaaagctgcataagcacattccggtggcagccggcatggcaggcggaagcacggacgctgcggccgtattatatggaatgaaccgcatttttgatctggggctttctaaggaggatctgatgacgcgcggtgtgaagctcggcgcggatgttccctactgtattatgcgcggaacggcgctcgcggaggggatcggtgaaaaattatcggcgcttcctccgatggtcaaatgtccagtgctgattgctaagccgcagatcggggtttccacaaaatttgtctatgagaatctgaagctggatgcggataccgtgcatccggatattgatgggctgatcggtgcgatccgggcgaagaatttggagcagatcgcaggacacatgggaaatgtgctggagacagttacgattcccaattatccggtcattgcagagatcaaggatcatatgatggagcacggtgcagtccatgcaatgatgagcggaagcggtccaacggtctttggcctgtttgccaacggggatacagccgtggctgcatacgaggcaatgcgtgaatcaaatcttgcaaaacaggtttacctgacaagcatatacaacaatgcgcggtgaggagaagacgggcagaaacagataacaaagcagaaggaggtacttatgacagaggatctgacattgaacatgaatgcataccttccgcttcgggatgtggtgtttaacacactgcgggaagcgatcttaaaaggagagcttaagccgggggagcgtcttatggagctgcagctggcagcaaagcttggggtgagccgcacgccgatccgtgaggcgattcgtatgctcgagcaggagggactggcggtcacgattccaagaaaaggtgcggaagttgcgcggatgacggaaaaagacatggaggatgtcttgcagatccgggatgcgctcgacgaactggcggcatccatcgcctgcgagcagatttccgaggaggagcttgcggagctcagacataccatgcatgagttcgaggaatccacaaagacgggggacgtcaagcggattgcggaggcggatgtgcggtttcatgacatcatctatcatgcgacgcgcaacgtcaagctggagaacatgctcaacaatctgcgggagcagatgtaccgctaccgcgtggaatatttaaaggatgaaaagaatttcccgattctgatccgggagcacagccagatcgtggaggggcttaccgcaaaggataagaccatgctgacggcggcgatgcacaagcatgtgatgaaccaggcgacagcggtgaaggaaatgatccgggagcaggaaaagtgaataaatttcccgaaatggaacaaactaacagggacaggcggatgcctgccccgtttttgttttaggaaaggaagaaaatctgtggcggagaagacaaagatcagcgagagactcgacgagaacatcgcacatatggaggaactgtttcacacctgtgacgacatcaagaagaagcggatgaatcttggaaaaaaccgggacgtggcgtgctacctcacgttcattgaagtctcggtagatatgggaaattcggcgctgttagaagttttaaaatacttaaggggtctggagcgggaggagattctgcgggtgttggaacagaatgccctcggaacctccgatgcgacctattttacgacgatcgaggaggcgggggacggtcttttgaccggagaagccatctttttcgtcgacggttttgcgaaagcggtcaagattccggatgacggttatccgaatatggggatcaacgaggcggactcggaaaaagtggtgcgtggttctaacgagggattcggggattcggtaaaacagaatgcggcgttgatccgcaagagaatccggtcgccacaggtcaaggtaaaagagaaaaaaatgggcgtgcgctccaacaccaacgtctatctggtctatatggaaggaatcgtctatcccgagctggtggcaaagattgaggagcggctggagggatttgagattgacggggtactcgacagcggagtcattgaacagctgtcggaggaaaaatggtattccccgtttccacagtttcagacgacggaacggccggaccgggcggcaatgtccatccttgacggcagagtggttgtgctgtcggacaattcgccgatcgcgctcattctgccgaccgattacaattcctttatcaagacgagcgacgattactataaccgctgggagatcgcaagctttgagcgccttttgcgctattttgcatccttttttgccatgacattgccgggactctatctggcggtcaccaatttccacacacagattctgccgaccacgctcctgctgtcctttgcggacgccaggagcggcgtgccgtttccggcggtgattgaggtgattatcatggagctttcgtttgaactgctgcgggaggcgggagtgcggctgcccggagcgatggggaatacgattggaattgtggggggactgatcatcgggcaggcagccgtggaggcaaatctggtgagtccgattgtcgtgattgtgatctcgtttacggcgctgtgttcgtttgctgtaccgaatgaggagtttgcaacggcattccggctgctcaagttcttttttatcggaatctgcgcatggcttggttttttcgggtttctggcagggctgcttgccgtgctgatccatctgtcgcacttaaaaagctttggcgtgccgtacctgatgccgtatgtggcggcagatctgaacgattatgaagatgaacgcgatttcctttggcggcagccacttcggctgctctggaaacgcccgatctacgcgaagaaaaataaccgcagaaagctgcggatgaaacagtgacagagaggaaacggactatgttttcagaaaataacaggatatcgggacgccagatgtatcggctgatgacgtatgatctgcttggcatcggcacacttctcgtcccacagatgcttgcgaagacggcggggagagacggcattctgtcaatcggaatcgggatggcggcagcgctcgcgtatctatggatattgcgcaggcttgcgccgcccgcacaggaatcttatccggaatatatggagcggcagctgggaagaatcgggggaggaatcgtacaggcaggttatctgatctacctggtgctgtttgcagggtatgtggcgtatctatttgcagacattattctccgggatcttctgcgcggagaatcgttttatctggtcctttcggttatcatgctactggtgctgtatggacttgcggggggaatcgagggacgggcgagagtctatgagatgctgttctggtttcttttgatcccgctgtttctcatgctctttgctgcggcggatgaagtgtgcaccgattactgggcgccgcttggaatgagcagcttaaagggcgtggcaggcggagcttacggggtgtttttgaatctttcctttgcatttctgcttcttttttcgggaacgtatgttaagcggcaggaaacattgtttgcggcgggaaagagggcaatcctatttgtgggatgtctccatgcggtgctctatctggttctggagggaattttcggggtaccggcgcttgcggggatggattatccggcagtcacgctgatgagcacggtaaaaatatccggcggctttttaaaaagaacggatgcgtttatgttcggcgtgtggttttttacgctttatgctcttttaaacagctgcgttttttatggaagcagcatagcagaggaattatgtaaacctattctaaaaatgccaaaagggaaaaagtacatgtggattttctatggatctgtggcggtggcagcgtctgcggcagcaatctgtttttaccggagcagagcggtattcgactggtacgagcggttcctgtggtatgtcggaacgccgtttctggtgctggcccccgtctttgccgcacagaaaaaatggggaaggaggctgcttgcgcttgcggtgatctgtgcagttgtcctgcttgtgatgacaggctgtgcccccgcggagctggaggatcgtgattttccgattgagattgcggtgagggacacgaaggatgccgggctggcgtggtatgaagcggagcaggcgggaaaccggatggtggattacagtcatctgaaggttctgatcctggaacaggaatttgtggaggatgaggcagccgtgcaggagtggctcgcgtttttgaaggagaagagcgaggtgccgcgcaacgcctatgtggtggtcacggaggatgccgaagcactgctggcgcagagtgagacgctgggagaagcggtcggggattatctggaggaacagtttgagaatgtgtcccagatcaaaaagcaggcgtaccccacgatcggatcgctgtaccaggagatggacaaccggcaggagacactgtttttgccgtatgttaccgtgaaggacgaaaaaccggcggtggagcagtattatgtgtggaagcgtgggatgccggcaggcatggttgacgcggaggcggcgagactcgctttttttacacaaaaccgcatgagggagtacggtttaccgttggaggagggaatgttactgctgtcggatgccacaaatgagatcacgttctcggaaaaggatggcgtgcgggaagtcctggtgacgattcactgcagcggaagcgtgcagggaaccggcggaaaggagaacaaaaaggagcttgcacttttggcggaagactatatgaaccggatggcggcaaatgtgcagcggaagcggcaggtggatcttacagacagttaccgcaagctcggaggcgcggcgcggggctggtatgaggagtaccaggagtgcggggagaactacgaggaagaggttgcgattgtctatcaggtaaaaataaactggattcatttatcataaagtgaataaaacggtatcaaaacgggaatcgtcttttgcagcagaggaaaggaagaaaatgccgttatgcaaagacgtaaatggatctggtacttgttgttgggaatgaatgtgatgctgcttgccctcctggaaatgcagtatgtgaaaaatcagagaatacaggagcagattgctgggaaggtgctgcggttccatgtgcttgccaacagcgataccgcggaggatcagaatttaaagcttgcggtgcgtgatgccgtgggaagccggatggcagagctgctttcggatgtcccggacagagaggcgtgcgagcaggtggtggaggcgcacctgcccgagattgcggagacggcgcaggcggtggtgcgggaagccggatatgagtacgaggtgcatgccgcgatagaggagacggaatttccgtccaaaacatatggaaaattcaccttcccggcggggaaatatgaggcgctgcgggttgtgatcggagagggcgaaggtcataactggtggtgcgtcatgtacccgaatatgtgctttgagggaagtatgtatgaagtcgtggatgagagcgccggggaggaactgaaaaaagtgttgtccaaggaggaataccgggcggtgcttgaggagggaaattataaggtgcgctgccgctatctgacatttttggacgacctgaaagaataggcttgattattccgccaaaagccggtaatatgagttgagataaaagggagtgtaacgatgacaaaagatgtattgatctccatcagcggtcttcagtttgctgggggagaaaacagtgaaccggtagaggtgattacctccggttcttattataagaagaacggcaggcattatattctgtatgacgaggtggcggaggatacggcgggtaccaccaaaaatatcatcaagctcggggatgaggtacttgatatcacgaagcgtggtgagacgaatgtacatatgatgtttgaaaaggacaagaaaaatgtcacctattattatacgccgtacgggaatctgctgatcggaattgacgccacgaaagtgcaggtggaggagacggaacacaatctgtccgtaaaagtggattatgcgctggaagtgaattatgagcacatggcggactgcaagattaccatgaatattcaatcaaaaaatgcagggaatttcaaaatctgaaataccctgcattttaaatagctgcttattttttcttcttctttgctgccttctctttggcaagttctgccttttctttttccagctctgcattcgcctttttggctttttcctgcattctcgcacggaagctcttcttgccctgcggcttctcaagaggccctctgacgccggttaccttcgtgatatagatgccgctcacggtcgctttgacttccttcttcagcggaatcagatcatagacggcttcgtctgcgatcagtgacatcaccttcggaccaacctttgcctttacgattggaagcttggaatggcgcatcatcttcggtgtctggtcgatgacaacctgcggaagtcccgaatctttcaggcgcatccgctttttatcgatgatcagcatggagacggtctgggcgttggctgcaagctgtgcctcctgctcgtctctctttttctgcgcctttttgccgagaaaatataatacgatcaagccgacaatgaggacggcaagaataaccagcaatacaatgtttacggtactcatggtaaaatcctcctacaatcaaactgcatttaattgtagcattgattcggcaaaaaagcaatcttgtatttgaaacatttgtgaaagtttggcttgtctgcttccttttttgagggaaatgtggtacgatactaaggttagtgttggcgaaacagaattcgccaaaagagggaatagaaagggtatttgtatatgaagaagagaacagtagcactgatgctttgcgctatgatggcgtttggtgcagcaggatgcggagcaaaggacgccgatccggcagcgacagaggcgacagagagcgcaacgtcaaccgagggtcttgcagacagtgcggtttccggtacgatcacaagcactccgtgtgcgagcagcgcgtttgacctgaagggaagcgattatgtaacactctgtgattacagcgcgattccggttacgatcaccggggattatgacgtggatgaccagaaggtaaaggactatttcaagcagatgtttgacaactatggtccgttctatatggcagatccggacaagaccacggtcgaggagggagacattgtcaatgtggattacgttggcaagcttgacggaacagcgtttagcggaggtaccgccgagaatcagaacattgatgtgtaccagaacgcatctgccacaggaacaggctacatcgacggatttacggacggcttaaagggcgcttctgtcggagatgtgatcgactgtgacgtgacatttccggatgattatggcaacacggatctggcaggaaaagcagtagtctttacatttacggtcaactccattcagaaggaaatgacgatcgatgatgtggatgacgcatttgccaaggagcagttccaggtagataccgtggatgagatgtacgatcagatccgcagctacatggagagcagtgccgagtataataagcagaaagacactacgactgccgtgcagaattatcttatagataattgtgaggcggaagtgccggaggattatcttactgcgcgtgtggatgattacagaagacagtacattgagcagaactgcaacggagacgagagccagcttgccgattatgtgagcacctactacggaaagaccgtcgaggagatggaagcatactggaatgagggaatggaaaagagtatccgtctggaattcattatggatgcgatcgcagatgagctcggcgttgaagtgaaccaggacgatattgatacctatgcagagcagctggtaagccagaacggatacgagtctgtggaggcgatgtataatatctacggttttggagataccgactatggcaagcgctatttcgcagatctctaccgctacgaccaggcgctggatcagctgcttgagacggcggttgtgaccatcgatccgtctgcggacacagagagtgacgcggtgacagaggacgctgcggatgcaacagaggcgggcagtgcaacaaacgcatctacgacgtatgaggcagcagaaggcacggagaagaccggggcagccaattaggaataagcattgattttttgcggcaatgcagataagataatagaaaagagataatgagtggcagacgggatgcggcagagtggcgcacccgtctgttgcggatggaggaatgtatggatctggtaaatataagggatttatttcgcagcaaggatgagtatctggatacgacagtgaccatcggcggatgggtcagaagtcttcgtaattccaagaatttcggctttatcgttgtcaatgacggtacgttctttgagccggtgcaggtggtattttccaatgtgctggagaactttgaggaagtggagaagttaaacgtcggcgcggcaatcatcgtgacgggtaagcttgtcgcaaccccggagatgaagcagccgttcgagattcaggcggagaagattgaggtggagggagcttccacaccggattatccgctgcagaagaagaaacacagctttgagtatttgagaacgatctctcatttgagaccgcgcaccaacacctttgaggcggtgttccgcgtgcgttccctgattgcctatgcgatccataagttcttccaggagagagatttcgtctatgtgcacacaccgctcatcacaggaagtgactgcgagggtgcaggtgagatgttccaggtgacgacgatggatcttgccaatgtgccgaagaatccggacggaaccgtggactatacgaaggactttttcaataagccgacgaatctgaccgtcagcggacagttaaacggcgagacatatgcgatggcgtttaagaacatctatacgttcggaccgacattccgcgcggagaattccaacacgaccagacatgcggcggagttctggatgatcgagccggagatcgcatttgcagatcttgaggacgatatgatccttgcggagagcatgctcaaatatatcatccgctatgtgcttgagaatgcgccggaggagatggcattcttcaataactttatcgacaagggactccttgaccgactgaacaatgtggtgaattctgatttcgcacgtgtgacctacacggaggcaatcgagatcttagagaagcacaacgacaagtttgagtacaaggtatcctggggtgcggatcttcagacggagcatgaacgctatctgacagaggagatctacaagcgtccggtatttgtgacagattatccgaaggagatcaaggcgttctacatgaagatgaacgaggacggcaagacggtagcggcagtcgactgtctggttccgggaatcggagagatcatcggcggaagccagagagaggacgactacgacaagcttctggcgcgcatcaacgagctgggacttcgcgaggaggattatgagttctatcttgatctcagaaagtacggttccgcaagacatgcgggattcggactcggattcgagcgctgcgtgatgtatctgaccggtatgtccaacatccgtgacgtcattccgttcccgagaacggttaacaactgcgaactgtaagagggaagactgaggtggagcatgagatatattttggaaaatgacacgctgcgggtcgagattgaatcgttcggcgcggagatcaagtctgtgaaacgcaaggcggatggaagggaatatatgtggtgcggagacccgagatactggggcagaacatcgccggtgctcttcccgtttgtcggcgcgccgaagaacaaggaataccggtatgagggcagaacctacccgatgggacagcatggattcgcgcgcgatatggagtttactctggaggcacaggaggaaaagagcatctggtttgttctctcctccacagaggagacctatgtgaaatatccgttccggttccggctgcacatcggatatatgctggacgaaaatgaagtttccgttcactggaaggtggacaacactgatgagaagccgatgtatttttccatcggcgcacatccggcatttttgtgcccgatcaacggggaacaggataagacgggctatcgtctccggttcggagatctcaccgacaagctgcatcatcacggcaacacgccggacggcatggcaatcatgacggatgaggagctggaactggaggatggagaggctgtgattacgcccggattctttgacaagtgcacctacatggtggagggagcgcagacgggagaggtgtcaatcctggaccgcgacggcgaagcctatgtgacggtacgctttgatgcgccgctgtttgctctgtggtctccggaaggaaaggaagcaccgttcctgtgcattgagccgtggtatggaagatgcgatgcggttgactttgagggaagcctggcggagcgcccatacgagaatgcgcttgcagccggaggcagttttgatgcagagtacgcaatcgtgtttgcatagccgcatgcgaaccggcatatagataggatagaaagaatcaggcaggtctatctatgaagctgggatacaaaataaaaccgagagatgcaaaaagcaacccgacgacagccatccttgccgccgtgtttgtgatgttccttataagcggtcttctgctgcttcttctggcgcttctcttatataagatggagccgggagagtccgtcattaagatcggaattgtggcggtctacgtaatttccgggctttgcggaggttttctgatgggaaaacggatgcgggagcagaagtttttgtggggactggcggcgggaatcatctattttctgctgctgtttggtgtgtcgctgctcgtaaagggtacgggtgatcttcagatgacgcgcattttttcaacgctgatcctctgcggggcatccggcatggcgggaggaatgttaagctgaaaagccgctctgtggggcgaaagttcagcaaaaaaaaggcttttcatctaaccggtcatgtgctatactatacgggttaatagaattttattgtaagatataaaggagagattattatgaagcacgttaagacattaaataccagaaagttacagaacaccatcaagaagggcggatgcggtgagtgccagacatcatgtcagtctgcatgtaagacatcctgcaccgtaggaaaccagagctgtgagaacagataatttttcacgggcataagtgaatagcattacttacagacgaccgttcgcgaagcgtgcggtcatttgtacgttataatagtcagaattagaaagagaggaaatattatagtggttcatcagtataagaacaacggctatgatattgttctggatgtaaacagcggcgcgattcatgtggtggatgacgtgacatacgatgtcattgccctgtatgaaggacatacaagagaggagattgtgaattctctgcgggagcgctatccggagactgaagtggaagaggcacttgatgaggtgcagatgctggtcgacaacgaggagctttttacgaaggatacctacgagaactatatcatggatttcaaaaagcgcccgacggttgtcaaggctctgtgcctgcacattgcgcatgactgcaaccttgcctgtcagtattgctttgccgaggagggcgagtaccacgggagaagggctcttatgtcctttgaagtcgggaagaaggcacttgattttctgattgccaattccggcaacagacgcaacctggaggtggattttttcggcggggaaccgcttatgaactggcaggtggtcaaggatcttgtggcatacggcagagagcaggagaagcttcatgacaagaagtttcgctttacactgacaacaaacggtgtacttttaaatgatgaggttatggaattctgtaaccgcgagatgggcaatgtcgttttaagtattgacggacggaaggaagttcacgataagatgcggccgttccgcaagggtgcgggaagctatgatctgatcgtgccgaagttccagcagttcgcggagagcagacatcaggataaatattatgtgagaggaacctttacacattataatcttgatttctcggaggatgtgctgcatcttgcagatctcggattcaagcagatttcggtggagccggttgtggcggagccgaaggaaccgtacgcaatccgggaggaggatctgccgaagctcttcgaggagtatgacaagctggcagttgagatgatcagacgtcataagagcggagaagattttaatttcttccactttatgatcgatcttgagggcggtccgtgtgtggcaaaacgtctttccggctgcggttcgggaaccgagtatctggcagtcacgccgtggggtgatttctatccgtgccatcagtttgtcggaaatgaaaagttccttctcggaaatgtcgatgagggcatcttaaatacagacattcgcgacgagtttaaatgctgcaatgtctatgcgaaggagaaatgccgcaagtgtttcgcaagattctactgcagcggcggctgcgcggcgaatgcctacaatttcagcggcgacatctgcggagcatatgacatcggatgtgagcttcagaaaaagcgcatcgaatgtgcgattatgataaaagctgcagaggaggaacaaaagaatgaagaagagtaaagcgattgttattttgatcgtgatccttggtgcactggcgggacttgcttattatgcatccatcattctttcttcgacgggaatcggggaagagatgagcattccgcttggtctggatttatccggcggtgtttccattacctatcaggttgtggatgacaatccgagtgcggaggatatgagtgatacgatctacaagctgcagaagcgtgtagagggctacagtacggaggcgtctgtctaccaggtgggagatgaccgtattacggttgagatccctggcgtatcggatgccaatgcgattctggaggatctcggtaatccgggttctctggagttccagcttccggacggaacggtttacatgacgggtgaccaggttgcggatgcgcaggcgggaaccacgacagacagctacggcaacaagcagtatgtggtacagttaaagctcacagacgacggagcaaagctgtttgcggacgccaccacagacaatgtcggcaattatctgccgatcgtgtatgatggcgagacgatcagctatccgcaggtaaaggaagccatcaccggcggtacggcacagatttccggcatgaagacgtatgaggatgccgagacactggcaacacagatccgtatcggttctctttccttaaagctgcaggagctggaatccagcgttgtaggagcacagctgggaagccaggcgatctcttccagcttaaaggcagcagccatcggattagtgattgtcatgatcttcatgatagtgatgtatcagattccgggtctggcggcagccatcgcgctggcaatctatacctgtctggtaattgctacattatacttatttgagattacactgacactgccgggtattgcgggtatcatcttaagtatcggtatggcggtcgatgcgaacgtcattatcttcgcgcgtatccgtgaggagattgcgacgggcaagacggtcaattcttcaatgaagatcggttttaagaaggcaatgtcagccatccttgacggtaacatcacaacgatcatcgcggcgttggtactgattgcgctgggttccggtacagtcaagggatttgcatacactctgatgattggtattgtactttccatgttcacagcgcttgtcgtgacaagatggatcctgtattccttctatgccatcggtatccgtgacgagaagttctatggccgtgcaaaagagcgcaggacgttgaacttcctcggaaagagaggcgtattctttacagtttccctggcaatgattgcagcgggatttatcggaatgggtgttcatgcagcaaagggaagcggagcattgaactatggtcttgacttcgtaggaggtacttcaacgacagcagactatggcaaggattacacgattgaagagattgagaataccatcgttcctgttgttgcggatgtgatcggcgacaaggacatcatggcgaacaaagtggaaggtacgacacagattacggtgaaaacgcgtaccctgacgctggatgagagagatacgctggagcaggcattggtggatcagcttggagcagatgagtcttccatcacatcacagagtatcagctcgactgtcagcagtgagatgcgttccgatgccattgttgccgtgatcgtatcttcgatctgcatgttgatttatatctggttccggttcaaggatatccgtttcggtgcaagtgcgattattgcgttgctgcacgatgtgctggtagtgcttgcggtttattcactgcttcgtatttccgtcggaaatacctttatcgcatgtatgctgacgatcatcggttactctgtcaatgatacgatcgttattttcgaccgtatccgtgagaacctgggcaggacagcagtaaagcagacgccggagcttctggcggaggttgccaacaagagtttgacacagacgctttcacgaagcatcaatacgtctctgacaacctttatcatggtattcatgttgtttttactcggtgttgcaagtatccgtgagtttgcacttccgttgatggcaggcctgctctgcggagcatattcttccatctgtattgcaacggagctgtggtacatcatgagactgcatcttggcaagaacagactgatcaagaaataaaacaaatattaggggctgcaatacattgaccaaagatgtatttgcagtcctttttattcccctacaggaaaaaggaaaataacgggaagcaggcatgaagaaacgtaggatagcgtgtataatggcatgacgcagagattgaccctgccatatttaccttctggcagtatagtgaaaaagggaagtgtggatggaattgagggagcggtagatctggatgtccagtttgtggagtgacatgaaaacggtcattgaggagaaatgagatggatgggatgaagttgtttgcaatctatttggcggttatgaatgtgctcggtgtggcggtcatgtggtcggataagaggcgcgccagactgcaccggtggcggattccggagaaggtgctctttggcgtgagcctgctcgggggaagcgcgggaacctgggcaggaatgtatttgttccgccacaagacgaagcactggtattttgtggtcggaatgccgctcattctggtttgccaggcggcacttgcaatttatctggtgcacttatatgttttataacaaattgttatagacggtatatgttttctgattgaataaagatacaaagtcatttataatgagtagcatagccgtagaaagacaaatgtttttcgtagaaagacagtgcggcggttcaggaagggagaatacatacgatgtatacaatggaagatatcgaagcggtagatatggaaatcgcacaggcaataaaggatgagtttgacagacagaacagtcatatcgagctgatcgcatcggagaactgggtaagcccggcggtgatgtctgcgatgggaagcgttttgactaataaatatgcggaaggctatccggggaagcgctattacggcggatgcgactgtgtggatgtcgtggaggagctggcaagagagcgcgcgaagaagctgttcggctgtgactatgtcaacgtgcagccacattccggagcacaggcgaatatggcagtgcagttcgcgattttaaagccgggcgacaccgtgatggggatgaatctggatcacggcggacatcttacgcacggttcaccggtcaatttttccggaacctattttcatatcgtaccgtacggtgtgaacgacgagggattcatcgattacgacaaggtgatggagattgccctcgagtgcaagccgaagatgattattgcaggtgccagtgcctacgcgcgcacgatcgactttaagaaattccgtgagatcgcggacgcctgcggtgccgtgctcatggttgacatggcgcacatcgccggtctggttgcggcgggacttcatccaagcccgatcccgtatgcggatgtcgtgacaacgaccacgcacaagactctgcgcggaccgcgcggcggaatgattctctgcaaccaggaagtggcagacaagtacaactttaataaggcaatcttcccgggaatccagggaggtccgctgatgcatgtgatcgcggcgaaggcagtctgcttcaaggaagcactgcagccggagttcaaggtgtaccagcagaacatcatcgacaatgcgcaggcgctgtgcaaaggactgatgaaccgcggtatcaagatcgtatcgggaggcaccgacaatcacctgatgcttgtcgacctgacgaattttgaccagaccggaaaagcggtggagaagcttctggattccgtaaatatcacctgcaataaaaatacgattccgaacgatccgaagtctccgttcgtgacgagtggtgtgcgtctcggtacgccggcggtgacatcccgcggattcaataccggggatatggatcagattgcggaggcgattgccatgatgatcaaggagggagagccggcggcagatcgcgccagagcgattgtggcggagctcaccgcaaaatatccgttaaaataaaatctttcaaagtgtgtagactaggcttccgtgcatattgtgagtgttcaatatgcgcggaggcttttttaatgttctattctacaaaaattattaagaattaaacgctatgtatcgggtctgaaaagatgatagaataaagaaaagaaagtaacccgtctggggcagaggaggagctatgggcaaaaagagcgttggaattctgatcggtgtggcagcagtggctgctgttctgggaggaaccggttattatttccgggatgatatcaggcagatgataccgatctttgatgatggaagttcagaggacaaggtctatgtggaaaaggtatcccgcattatgaatcagtatgcaggtgtttccaaccggtataacggtgtggtggagacgcaggattcatacgaggtgaatgtggattcttcccggacgatcagcgagatcaaggtggaggtcggcgatgaggtcgaggagggacagactctggtcacttacgacaccagtgaccttaccatgaagattgagcaggcgaagctggagctggaaggcatccagaatgagatagataattacaacaaacagatcgacacactgacgaaagagatggagaaggtggacgaatcggaacgctacgattacaccacgcagattcagaatatccagaactccatcgcacagaagcagttcgatatggagagcaagaagcttgagatctccaaggagcagaaacaggtcagcagttcttccgttgtgagcaaggtggcgggagtggtcaaggagatcaatgagaaaggcgtggacagcaacgggaacagcgcgccgtttatgacgatcttacagactggagagtaccggatcaagggaagcatcgatgagcagaatgtctggatgctttccgagggacaggaggttgtgatccgctcgcgtgtggacggcacgaagacgtggagcggaacgatcgggaaaattgacacggagagcccgcagcaggggaacgataacagctattacagcacttcttcggcgggagatacacagtcagcgtccaagtatccgttctatgtggatctcgactcggtggacggactgatcctggggcagcatgtgtacatcgagctggatcagggacaggaggaagtgaaggaaggtctgtggctgtacggctcctacatcgtgcaggacgaagataccccgtatgtgtgggcggctaatgagaaagaccgtctggagaagcgctacatcgagctgggagagtacgatgcggatatggatgagtatgagatcgtatcagggcttgcagaggacgattacattgcctggccgatggctggtctctatgagggtgtgacgaccgtgaccgacgaggcggaagtggattattcttctccgctttacaatcagccggcggacgagaatctgtacgatacagagggtgtctatgacacggaactgctctatgatgtgttggacagcgtctatgatacagaactgccggatgaaatgtatgacggtatggatgccggagaagggacagaggcggaggtggcagaatgatactgaatctgcagaatatctacaaagactatcagcaggagaagctggttgtgccggtgttaaaggatgtatcgctgacggtcgaggaaggagagtatgtcgccattatgggaccgtccggttccggtaagaccacactgatgaatattatcgggtgtctcgaccgaccgacgagcggtacttacgagctggcgggggagaacgtgctcaaattaaaagacagggaactctcggatctccgcttaaagagcatcgggttcgtgttccagagttttcagctgatgccgcgggagagcgccgtggaaaatgtggcgcttccgctcagctacgccggagtgcgcaaaaaggagaggcggatccgcgcgacgaaagcgctcgagagagtgggactcggggatcgtgtcaatttcagaccgacacagctttccggcggacagaagcagcgtgtcgccatcgcccgcgcgatggtcaaccatcctaagattctgctggcagatgagccgacaggagctctggactccaaatccggcgagcagatcatggagctttttgacagcctgaacgaagagggcgttaccatcgtcatgattacgcatgatcccaggattgcggcgaaagccaagcggattgtccggatcatcgacggtgagatctatgagggagagggggacggagcggtatcatgaagattaagaaagtgattgcggtcatcgcaggtattgcggtcaccctctcggctgcggtgggaggcgtatacgggtataagtcctatcaggacaaaaagcttatcgcggaagtgcagccggtttccaacctcaactggggatactggggagacacggagacaagttatggcaccgtcacgaacgattcctcacaggagatctatctggatgattccagaatgatcaaggagatctatgtggagaagggggatgaggtgcaaaagggagacccgttgctcgcctatgacacggcggaactccagatagagattgaacgcaaaaaactcgatatcagcacgatcgagaataacatcgagagacaaaaatacaagtatgaaatgttaaagacgcagacgccggtgaaaaaagatccgccgaagctgaacgaggagcagcttgcctggtatcagcacatggacgaggaaaaccgcctgacagagacagataagaacgacagcagaatctacaactatctgacggcggcctccattccctacaacgtgacaaccaatgcggcgggggaactggtgtatccggcaggaacagcggaagaaccgtatatttattatgtcaaccagaatgcatacgcctacggcggctttttcaatgccatccgtcctaccgcggagggaggcagcggaaaacatgtgcgcgtgatcgtctgcaagaaggatgcggacggtaagatggtgcttgacaccgatgaagcgaccgggcggcagacgccggttgcggatgatacagtgtccccgaataccgtcgagttaaacggcagcgattttccggcggattacgatgagagccgcatgtggtatctgttttcgggaaaagaatacataccgacctcccttgcggatgagtacatgcaggcctacgaggattttatggcggactgggaggtgccaaagggatatacttccgaggaactctatcaggaggctgccgagattgaagaaaaattaaagatgctcgatattcagcgcagacaggaacagctggcgctcgagtccatggagaaaagtgcgacggacggtgtggtctacgcggaggtggacggtgtcgtcaagacgctcggtgatccggacgagaagcccgagcaggggcaggcgtttctggtgataaccggagatgacgggctctatgtaaaggggacgatcagcgagctgcttttggatgatgtgaagatgggaaccgtggtgactgccaattcatgggagagcggcatgacgtttgatgccacaatcacggaaatatcggattatccggtttcgggcaactcgtggggcgatggaaatcccaatgtctcctattatgagtacacggcttatatcgaggacagttccgcgctccgcaacggggaggcggtagatctgtccatatcgaccaatcagtccgatggcggcggcatttttatagaaaaagcgtatgtgaggtcggaggatggaaaggcgtactgtatgattgcagatgagaataaccggctgaaaaaacagtatgtggtgaccggaagaacggtgtacggatctgcggtagagatcaagtcgggtctgacggaggacgaccgcatcgcattcccgtacgggaaaaatgcggtggagggcgctgccgtcacggacgaatcatccaattattaaaggaggaacggagatgtttgaaaatataagattatctttccgcggaatctgggctcacaagatgcgttccttcctgacgatgctgggaattattatcggtattgcagctattattgcgattgtatctacaattaagggaacaaatgagcagatcaagcagaacctggtcggagccggtgagaataccgtcgagatttccctgtatcagggagagtgggaatatgagatggagtacaacggcataccggagggcgtgccgcttgtggcggatgaggtggttgaacagctcaaggagatcccgcatgtggaaaatgtgtcgcgctatctgagccggcaggattacaacggagtctatcatctgaataccgggctttccggtggttatgtcaagggcgttgacacggcttattttgacacctgcaattatattatgaaggaagggcgtgggttcacgcagcaggattttgaccagtatcacaaggtcgcgattctggatgaggattcggcggacgcactgttccagggagaggaagctgtcggggagacgattgagattcagcaggagccgtatgttgtggtgggaattgtgacaaaggcgaaaaagtttgaaccggtcatcaactcaattgatgactattatacctacgcgcaggattccgccggctctgtgtatgtgccggcgacgacctggccgatcatctatcagtacgacgagccgcagaatgtggtgctgcgcgtggagagtacggatgatatgaccagcgccggaaaagcgggagcggatctgctaaacgggtatctgtcggtgtcggatacgacgatccagtataaggcaaaagatctgatggagcaggcacagcagattcaggaactcagcagctccaccaacaccatgctgatctggattgccggcatttcattgattgtcggcggtatcggcgtcatgaacatcatgctggtatcggtgacggagcggacgcaggagatcggtctgaaaaaggcgatcggggcacgcaagtcccggatcctgggacagtttctgacggaggcggcggtgctcaccagcctgggcggtctcatcggcgtgctggtcggcattattctggcgcaggtgatctcgtatgtgacgacgacgccggtggcgatcagtgttccggcagccgtgggagcggtggcgttttccatggttatcggaatcgtattcggtgtgttcccgtcctacaaggcggcgaatttaaatccgatcgatgcgctgcggcatgagtaagcaaaaaataatgacagcgctgcggacagaaaggagccggcatgataaaaagaattgtcatgatggagggcggagtggagacactatcctacttctcccatcagatggcaggagagtttcaaaaactgggatacgcagtatttttctatgatctaaaacaggaggagagcagcgctggaaagctgcgcaagtttatcagaccgcgcgagacggtgcttgtgaccttcaattttcagggactggaaaaggaggcgggcgtgtaccgcgaggggatcggttatctctgggatacctatcatattccctgttataatattgccgccgaccatccgtacttttacgatgacaggttaaaagatctgccggaaaaataccggcatatcagtatagaccggagacagaaggcatattttgaagagttttatccggagtatgtgtcgcgtggctttctgccgcttgcgggaaccggattgcggcaggcagaagaggaaggcgaagctgagcagggaaaagcgcgagcgcagggcgccgcagttgagacgggagaaactggagcgcagggcgcagcagaacaggcggcgtcctgctatgacgtgatcctgaccggaaattacacaaagctttccttttttgaaccctatatcaactggatcaatgaggagtacgcggcattttaccgggggatcatagacgatctgttggaacatccggcgtgcacggtggaggaagtggcgcttgcccactgcgagcgggagatggggaaagagcccaatgatcagctgcggattgccctgcataagatgattttcattgatctgtatgtgcgcaattactggcggggaaaggcggtgcgcacgctcgtcaatgcaggaattccggtacatgtggtcggaaaaggctgggaggaactggaggatgtgagacatccggagtgcctgaagctgcacccgcagaccgattccgttacctgccttgagatgctggcggacgcgaaggtgtctttgaacgtgatgccgtggtttaaggacggagcgcatgacagggtgtttaattccatcttaaacggagcggtatgtgtgaccgatccgagctgttacctggaagaggaacttcatgagggcgagggcgtctgctatgttgcgctgcaggatatggacgctcttccggaaaaagtgaaggatttattgcaaaatgattccgggaggaatgagattgtgcggcgtggcagagcgattgtggagcagaagcatacctgggcacagcgcgcgaagacgctggcagcgtggattgcggaggacgccgcgcaatagataaaggacaaagtgcggaaaatacaggggattcgatgcggactgggcgcggatcgggcgaatctgcatattaaccttgcattttgcggataatcattatataatagcggaagaattggcgatgaagaaagctgcggtttgaagactgcgacagagagccggtgggtggtgcgaaccggtgcaggatagaatctttccacttttggagccggcagtgaaagctgcgagggtcgtatcctttaacatacgtttgagaggtcgcaggaacatgcctgtggcaagatgggtggcaacgcggaagcagaacctttcgtcccatgtgcaagtggtgcccggtcagagatggcggggacatttgacacaggggcgaaaggttttttgttcctgtgcggatagaacagaagaatttaggaggaaatgacatgatcgatctgaagtttttgagagagaacccggaggttgtaaagcagaacattaagaacaaattccaggatcacaagcttccgcttgtggatgaggtaattgaactcgatgccgaggcgcgcaagacacagcaggaagcagacgatcttcgagcaaagagaaaccagctgtccaaagagatcggtaaactgatgggtcagggcaaaaaggacgaggctgaggctgtcaagacacaggttgcagagggagctgcccgtctggcagaattagaggaaaaagaaaaggaacttcaggagaaagtcaccaagatcatgatgacgatcccgaacatcattgatccgtccgtaccgatcggcaaggatgattcctgcaatgtggagatcgagaagtttggcgagccggttgttccggattttgagatcccgtatcacaccgagatcatggagcgttttaacggcattgatctggatgctgcaggcaaggtggcaggaaacggattttattatctgatgggcgatattgcgcgtgtacactccgcagtgctctcctacgcgagagatttcatgatcgaccgcggttttacctacgtggtgccgccgtttatgatccgcagcaatgttgtgacgggcgttatgagttttgatgagatggatgccatgatgtacaagatcgagggcgaggacctttatctgattggtacctccgagcattccatgatcggtaagttcatcgatacaatcaacgatgaggagaagctgccatatacactgacatcctactctccatgcttccgcaaggagaaaggcgcacacggcatcgaggagcgcggtgtttatcgtattcaccagtttgagaagcaggagatgatcgtagtctgcaagccggaagagtccaagatgtggtacgataaactgtggcagaacacggttgacctgttcagaagcctggatatcccggttcgtaccctggagtgctgctccggcgacctggcagatctgaaagtgaagtcctgcgatgttgaggcatggtctccgagacagaagaagtatttcgaggttggaagctgttcaaacctcggcgatgcacaggcgagaagattaaagatccgtgtaaagggcaaggatggcagcaagtattttgcacataccttgaacaacacggtggttgcgccgcctagaatgttgatcgcgttcttagagaacaacctcaacgcagacggaagcgtcaatgttccggtagcactgcgtccgtatgtcggaggcaaggagaagctgattccggtaaaataaatatgcacaaaaaacggtctgccggatagggcagaccgttttttttgtgttatttatttgcacttcggagaattgcattagcacttctctggttccggatactccacaccgaacgtttcgacagtcacttttttcatgacctgcggagcgagcgggcggtcgctatagtcggttgcagtctctgcgatcttgttgactacgtccatgccttcggtgatcttgccgaatgcagcgtatgcgccgtccagatgcggggaagtcttatgcatgatgaagaactggcttccggcggaatccggatgcatggctcttgccatggaaagaacgccctctgtgtgctttaagtcatttttgaaaccgttctgggaaaattcgcccttgatatcgtagcctgggccgcccatgccggttccgtccggacagccgccctgaatcataaagccgttgatgacgcggtggaagatcagtccgtcatagtagcctttctggatcaggctgataaaattgtttaccgtatttggtgcgatctcaggatagagctctgccttcatgatatcgccattttccatctcgatagtaacgattgggtttgacatagtatacctctttctgccctgtatgcgggcgggtgaaataagaagcagcctgctgtgacagcagtcatccgccgcctctacggcactattgtagcgaaaaagagcggattcgtaaagagaaacgatggaatttccgaaaaagtcttgccctgcaggcaggaagagtgtaacattaggtagattcaggaatgctattttgaaggaaaaattgcaaatgaatatgaaaaatataatcaagaataaacaaaaggaacttatgcagggaatgattgcactgatattatgcgtggcgttattttgcagtgcggctgtctctgggaaaaatgacggatctgagtggaaaatgcgccatggcgggcagaaatatgaggagacgggaactgatggtcaggtgcagacaccactatatgcaggaattcttgcagaatttcgcgcgaatgagatggcaattttgtcggacaaccaggagattcttgcgaaagcagcagagcgggcagcggaggaggcggcacatccggaacagggcgtctacacatttttacagggaccgaagtcctggacagagggacgggcatggtcgggggagtggtcgaaccagtatgtcagaggcaattacttcggcaatttcggatgcggtctgtgctgtatggcaaatatctactgcacgcttacggagtatacctgttctccgtgggacatgtacgaatatgcgaggcaggtgtccggctatgcaccatcgcggaagatcggggcaatcggctgggcggatatgaaagttacattgcgaaaaagcggttttgactgtaccctgaacacaaaaccggaaagctatgagcagttccagcaggagatcacggcgtcacagatggcggtggttctggtttccagcagggacgatgatacctactggaagaagacgggagggcattatgtgtcgatcagcctttacgatgcgtcgtcagatcaggtgttcctcggggatccggcggatccggacggcaaccgctcctggattccgctgcgctacgtgtatgacgcattaaaaaccgtcagccagtatcagtatcttctggtacaggattatgcggaggaacagaatcagtggatgcatgacgggattacggatgcatggggaggaatgtaatatatatttgacatattgtaaagcagatgctaccataaaagaagaaatcagaaactatcaggactgtgtgacaggaaatgaaacaggaggattggaagatgaaagaaaatgtggcgtatctgcttgggattgtggcagggctggcggcggtaggaattatctgctgggtgaagaaacggggacgcagggaggctgactatgatgagcggcagtatcagacgcgcgaccgcgcctgccggtacggttttctgatgctgctgttgtatgaactggtatatggggcattgtatatgaaagaagcgccgtcctggtgcgactatacgatgggaaattatctgggaattggtctggcactgcttgtgttcggcgtatattgtatctggaacgatgcttatatgaacctgaaccagaagccgtggagcgtacatctgctgtttggagtgctggcactgtgcaatcttggaatcgcggaaaataaccagcggatcggaacgctgtttgcggacggaaaactgggatttggcgcggtgaatctggtgtttgcagtgatgtttattgtctttgaaattgttttttttataaaaagaagccgggagaagcgggatctgtcggaggaaaaagctgaatgaaaaatctcaggttaaaagcggcgcgcgcggcaaaggatctgtcccagcaggcgctcgccgagaaggtgggagtgtcgagacagacgatcaatgccatcgagaagggagattataatcccacaatccggctgtgcattgcgatatgcagggagctggacaaaacgctggatgaaattttctgggaagaggaagaatgttaaagttagaatatattttaattggaaagctgccaaagacagagcgtgacatgctgctggagaatctgagaacagagcgggaatgtgggcggaacgttttggaatgggacagcgcgaagaaacacattcaggaaggggcgcttgcggaaaaggcaattttggtctcggaagatgcgaaggaactaagcgaggcacagcggatcgggatggctgcgctttgctatttgatgccggaggatggaaggacgcagagagaagagaccgccggggagatggaagtgacgtctccggcggatatgtatgcggaagggatggaggagatcgacggatcttttttacagcatgtctatgagagacatcatcgtattccgtggatcattttaaaaacgccgcgctgcatcgtgaaggaattttccatggaatacttagatgcactgtttgaactgtatgccgggaaaggaatgacggactacatggagccgctgtatccgtatgaggaggagcgggaatatcagcaggcgtatatcgagcagatgtaccggttctacggatacggcatgtggatcgtgtgcgacaggaataccggagagctgatcgggcgcgccggcgtggaacaccgggaggagctgggcggagagctggagctcggttatgcgatcggtgtgccgtggcagagacagggctatgcgacggaggtatgcagtgcgattcttacctatgtaaaggaggaactcatgctgccgtcggtcagttgtctgatcgaggaggggaacgtagtatcggagcatctggcgcaaaagctgggctttcattactgtgaaacggtgcagatagatggaaaacagatgagaaaatacaaagttgcattttattaggaaataaaatataatattgaaataaaaattatcatggatgaagtgggtgaggcacatggcagattactctcagaaagaaaaagaacttgagcgtgagcatttggaaaaactggtaaaggaagaggaccgcagtatcaagccaatgaaggagtttgagagtccggaggatttgtatcatgagctgatcgccagtgtgcgcaaatatcacccttccgcagacatttctcttattgaaaaggcgtatcatgtggcgcgggacgcgcatgagggacagacgcgcaaatctggtgagccgtatattgtgcatccgctgtgcgtggcgatcattttagcggagctggagcttgacaaggagacgatcgcggcaggtctgctccatgatgtgcttgaggacacggtcatgacggcggatgagatcaaggaggagttcagcgaggaagtgctgcttctcgtggacggcgtgacgaagttgcgccatctgcatcttacggacaacagccataatcacgaccagaaggaccgctctgcggagcgcttagagatgcaggcagagaacctgcgcaagatgttcctcgccatggcaaaggatatccgggttattttaatcaagcttgcagaccggcttcacaatatgcgtaccttaaagtaccagtccaaggaggcacagatccgcatcgcgcgtgagacgcaggagatctactgcccgattgcacagcggctcggtatttcaaagatcaagattgaacttgacgatctctcgttaaagtatctggagccggaggcatactacgaccttgtgcgtcagattgaccagcgcaagagtgtgcgcgacgactacgtgcagtcgctcgtggaggaagtgcgcgcgcatatcaaggcggcgggaatcgtggcagagattgagggacgcgcgaagcattttttcagcatttataagaagatggtgaatcaggataaaacgctcgaccagatctatgatctgttcgccatccgcatcatcgtggattctgtcaaggactgctatgcggcgcttggtgtgattcacgagatgtacaagccgatcccgggccgttttaaggattatatcgcgatgccgaagccgaacatgtaccagtcgcttcatacgacgttaatcggaccgaccggacagccgtttgagatccagatccgtacctatgagatgcaccggacagcggaatacggtatagcggcgcactggaaatataaggaagcgagcaacaacggcggcgcggcagtgccgatgactgtcacggaggaggagaagttaagctggctgcgccagatcttggagtggcagcgcgacatgtctgataataaggagttcatgagccttttaaagagtgatctggatcttttttcggacacggtattctgctttacaccgaccggcgatgtcaagaacctgccgaacgggtcgacgccgattgattttgcgtacagcattcactccgcggtcggcaacaaaatgatcggtgcaaaagccaacggaaagctggttccgatcgattatgtcatccagaacggtgaccggatcgagattatcacttcgcagaactccaagggaccaagccgtgactggctgaacatcgtaaagagtacccaggcgaagaataagatcaaccagtggttccgcagtgagctgaaggaagaaaatattacgcgcggcaaggagcttctcgtggcgtcctgcaaggcgaagggaatcaactttgcagacatcaacaagccggaataccaggagaaagtgctgagaaaatatggtttccatgactggaattcctgtctggcgaccattggacacggcggcttaaaggaaggccagattgtcaataagatgtacgaggaatataagcgggatcatctggcgcggatcacggacgaggaggttcttgagaccatcggttccgagaacaagaatccggagtcggcgaagcgctccaagagcggaatcattgtcaagggactttacgatgtcgctgttcatttttccaagtgctgcagcccggtgccgggagatgagatcgtgggttttgtgacgaggggacgcggcgtgtccatccacagaactgattgcgtcaatatcatcaacttgtcagatatggagaaggagcgtctgatcgatgcggaatggcagcatgacggtcaggacggcagcaatggtctgtatcgcgcggagatcaagatttttggtaacaaccgtaccggacttctggtcgacatcacgagagtgttcacggagcgtgagatcgatattgatgcgatccactccaagacgagcaaacagggcgtggcgacgatcgatgtgtccttcagcacgaagggcagagaggagctgggcagcgtgattgataagctgcgccagatcgacagcgtgattgatattgtgagaacgacaggctgatgaagcaggaaaggcagacggagggaaaaagatggcgcctcttaaggtagaacagtatgtggtaggaccggtgcagacgaactgctatttcgcggtcaatgatgagacgaaagagatgattctgattgatccgggggcaaatgcggatcgtctgatacggatcatagaggaagaaaagttaaatcctgttgcaattttattgacacatggacattttgaccatgccgggggcgctgcggaagtcgcagcgcattttggtatcaaggtctatgccgaggagcatgagagagagaccctcgatgatccaaagctgaatctgagcggatggacgggagcggagacgacctatcgcgcggatgtatttctgaaggatgagcaggagtttgatctcgcgggattccatatccgggtattgtttacaccgggacacacggtgggtggctgctgttattattttgcctatcaggacgcccttttttccggggatacgctgttcgcccagtcggtcggaaggacggattttccgaaggggagcgcttcggcgctgattcgcggcatcaaggagaagttactgccgcttccggatgaagtgaccgtctacaccggacataatgacaccacgacgatcggaacagagcgcagatacaatccatatctgtaagcgtatgatccgggaaaccagaggttttccggacttttgccgaagcaaagacgcatatgatataatgaatcctatcggattcatattagaagttcctgcggaacttcggatgcgcagaaagcagcgcaaaaagatgatataatatttagtttagaaaagagtcagatatgatagaagtaacattgaatcaaccggaatttgagtacgatatccattcactcatcaaggcattttatccgtcggaatacgtcggagtatccgcggaaaagaaggagtatgacgagccggtgacatcccgcatgcatgtggagtacacggacgatgcgataacgctgcgctggcagcagggagagacggcgcctgcggtggagcgtacctttgcagtcgatcctttagaccgcccggagacgaagaaccggctgaaacagaatctgtatgcgcttctgtcggatgcgaccggtcagtatctgccgtggggaacgctcacgggaatccggccgaccaagattccgatgaagttgctcgaagagggaaaaagccgggacgagatctatacgtatatgaagcagacttattttgcgtcggatgagaagatctgccttgcgacagacattgcagagagggagctctccctgctttccaagatcgattatgacaacgggtacagcctgtatatcgggataccgttctgtccgacgacctgtctgtattgctcgtttacctcctatccgattgcatcgtgggcgaagcgtgtggattcctacctggatgcgctggagcgggagattgagtttgcggcggtgaagtttgcgggcagacatttaaattccatttacatcggtggcggtacaccgacgacgttagaaccttatcagctggacagactgattcggaaaattaaatgcagttttgatttatcagactgcctggaattcacggtggaagcgggaagaccggacagcattacatacgaaaagctgaaggtgttgagacagcatggaatttcgcgcatctcgatcaatccgcagaccatgaagcaggagacattaaagctgatcggcagacatcacacggtggagcagacggtggagagttttcacatggcaagagaactcgggtttgacaatatcaacatggatctgataatgggacttccggaagagacactggacgatgtgcgccggacgatggagcaggtggcagagcttgcaccggacaatctgaccgtacattcgctggcactcaagcgggcagcgcggctgaatatgttcaaggaagattataaggattacaagatcatcaacacgcaggagcacatggatctggttgcggactgtgcggcgcagatggggctttttccatattatctgtaccggcagaaaggtatggcgggcaatctggagaacgtcggctatgcaaaagagggcatggcgggcgtgtacaatgtgctgattatggaggagaaacagaccattgtggcatgcggagcgggagcttcgacaaaacgtgtctggacagagccgaatccggatggcacgcaccggattgaacgtgccgagaatgtcaaggatgtagcgcagtatatcgcaaggattgatgagatgatacagcggaagcagaagctttttgcagaagaataaaagggttattcatcctgaaatagtacatcaaaaaagtatccaataatacggaataacctgtgagatgtattgaaacaacctaataactgtgccttaaaggacgaattcattttagcagatgagttcgtccttttctgttatagtcaattattctaggagaaaaagaacatgaataacacagcgttaggagcaaaatgagccaatgaaagaagtgtctacaataccttctttggaaagaagtaacacctgagttttcgtgatttcagagagaatttcattattgaaatttttcaggaagagtttcatgacattccagaaaatttgaaatatggggaaatatcacaaaaatcgaatgagaattttgtggcgggttacacgtttaacctttgtgaaaactatatttctattgtaatattgaagcagaatattacaaatcagtaatcaatgtgatgtagaacaaaggagaaaacacatgaataaagaaatgaccgtaaatgggaaaagctatacaataattaaattgctaggaaagggaaaaggtggatattcttatttggcagagtctggaaataacaggtatgttttgaagcagatacatcatgaaccttgtgattattatcagttcggaaacaagcttgaggcagaaatcagggattacaagaaattgaaagagatcggaataaagatgcctgccatgcttgaagcagatgtgaaaaatgaacgcattttgaaggagtttattgacggcgacacgatttatcagttggttttagaagacaagatgaaaactgactatatcgagcaattgcatagaatgtgtgcgctgttatatgctgccaatacaaatattgattattttccaacgaattttgttgtaaataacgaagaaatatattatgttgatttcgagtgcaatgattacatggaagaatggaattttgaaaactggggtgtaaaatactggtcaaagacaccggaatttttgcagtatgtgaaagaacattcatgatactcggaagttgaaggagaaatttatgcaaaagagtataaattatatttgccagataataaactgttacagaaaaagctaaaagaatggctggatgaagaacagaattgattcagaggggagagtgctatctgctgggatagtattctcgggagtatcccaaaggacatttctaattacttagaaatgtcctttttcgcatttgtgaatggtcattgatgctacagaatgtcagaatttacttgtttgcgctgtcagcatcaatcacagactggatctgcttcatcaaagcatcatagttgtcctggttatcgattccgccgagcataggttcgcctattatattaccatttctatcgactaaaattgttgttggaaatgccataatatcagcagcatatttaccggcggctgaatcagagtcaatggaaagattgcgataagcggcgccctggctttcaaggattttttttgcttcttttatagcagcttcattttcatcaaaagtttcggtgttaataccaataacttcgccccccattgatttaatagcgtcatttaattcgttaagtttagataattcagcaacacaaggcttacagccggtaaaccagaaatttatgacagttacggcattcccggaaaacaaattctgatcaacggcattgccatcaaaatcttttccggagaaattctggaaaggggctgtatcatcggaatcatttttggcgccggaagtatcggatacagcattttggctttcaatttcagtgatctgttcttcgattttacgaatggtcttaatatcatcggtaagagtttttaactcgctgtctgtaaacgaagtcttgtttgcttcgacagtatcagcaagataatcagcataatttccatctggatcagcagtacttttattcatcatgccaaaaaccttgtcccatacatctttatgatctgcaaagatctggttttcctgctgatataaatcatcaagcgctgcattggagtcatcggcagatgattcgctggcggatacagcagcagtattctgcgtgttctctgtttttgaagtctcctgcccggcacatccggtgattgataatgcggtacagagtgtaaaaagtgcgataatgtttctttttgttttcatgataaatactcctttaattgataagaattaaatagctgccggctggctattgctggttattgagattgctgctacatgttttttccataaactggtaatggattgcatcctttggacaggctttcatacaggcgccgcatcgtatacattccggatgatttggagtcttacggacatcgacatccattttgcatgcacctgtacacagaccgcatccgacacatttactgttttcgaccttgatgttgagaaaggatattttattaaaaagtgaataaattgcaccaaggggacaaagccatttgcaaaaaggtctgtaaaacaaaatacttaagacaataacagtaattaaaataaggcatttaaaagaaaacagcctgccaagtgcagatcgtatggcggaattcccgagggacagaggtatggcaccctccaaaacgccctgtggacatatgtatttacagaaaaacggatcccccattcctatggagttcgtcacaagcatcggcagtgctataacgaaaacgataagaatgatgtacttcaggtatctcaaaggctttagcctggccgtagaaaattttttcccggggattttatgaagcagatcctgaaaccatccaaaaggacataaaaatccacatataaatcttccaagtgtcacaccgagcagaatgaaaaagccggttatgtagtacgaaaatttaaaatttgaggatccgacgactgcctgaaaagctccaattgggcaggcgcctgcagctgcagggcaggaataacagtttaatcccggcacacatactgttttggcatttccctgatatatttttcctttaaataaatttggaatatgaatattggtaagcaatgtggcagctgcctgaatccacccgcgtacccgggctactttttttgatcgtatagttgtttttttatccaattcccacacactccagacataatttaattgctttgccaagcacggtagctgcttcgcctctgattgcaccataaccgatcataagtgtaccggtgatgaataaagcgaactgtgatattcttttccgcatcagacagattactcctttcgtttgctgttattgtctttgttgaccagctgacagtagtattatacaatagtggatgtaaaatccttgttaagaagcgggagaaatattttgagattattgattgttgaagatgaaaaagaattgtgtgatacaattgcaaaaagtctgtatgatgcgggctatgaggtggatacctcttataatggaagcgaggcgcttgaatatgtcctgacggaggaatatgatctcattgtgcttgacctgaatttaccgggcatagatggaatggatattctaagggaactcaggcgggagaatgaggagacaaaggtgctgattctgtctgcgcgaagccagatagcggataaagtggaagggctggatgcaggagccaatgattacatggaaaaaccatttcatctgcaggagcttgaggcgcggatcagaagcctgacaagacgtaaatttgtacagagagatgtttgcctgaacaatggggacataaggttcgatacaaaaaagcgcgaggcatatgcaaaagaagagagggtgcctttgaccagaaaagaaagtggaattttggaatatctgcttcttaatcagggcagaccggtaagccaggaagaactgatagagcatgtatgggatgcatctgtggatagttttagcggagctatcagggtacatatgtcttctctcagaaaaaaacttaaggcagtgctgggatatgatccgattgtgaacaaggttggtgagggttataagatgcgagaggaatcagaacaatgaaaaaaatgtcacttcagtggaggcttacgatcataactacattgtttattgcagtcatatgtggatgccttaccctgtttgtatataagaacggtgtgtattatattgatttgctgcaggatactgttgatgcccagagtgatgaggacaacagtgaggaggctgatgaaatatatattaatattccagatgataaatgggatgattttgcagatgatttttccattcaggtatataacaacaaagcagattataaaaaaagaagcttgctgttctctacactgcttgcgcttcttggaggtgttgccacatattttctaagcggacatgtacttaaaccgcttagaaatttttcagataaaattgagaaagtgcaggcacaaaatctggcagattcgaggatagaagagaatgaagttaaggaattaaaccggctcagtgtttcttacaacaagatgctggaacgcctctcagaagcatttgaggtacagaggcaatttacggcaaatgccgcacatgagtttcgtacaccgttgtcgctgatgcaggtacagcttgatttatataattcgatggagcacccgggcaatgacgaatgtgcggaaaagacaattgccatgatgacggagcagaacgaaagactcagcaggatggtaaagattcttctggatatgagtgaacttcagattgtggtacgtgatgaaaaaatcatggttgatgcacttgtagaagaggtcctgacggatctggaaccacttgcaatggagaaaaatataaggcttattggaaaatgtaaggatgtaactatggtgggaagtgatatccttatttacaggctggtatataatcttgttgagaatgctataaaatacaatcgtccgggtggacaggttgttgtgatggcggagtggaaagaaaaacatgtttttctttccgtagaggatacaggaagcggaattccagaggaactcagaaaacgggtatttgaaccattctttcgtgtggataaatccagaagcagggaactggggggagtaggccttggacttgcgctggtttatgaaattgtgagagtgcatgatggcaatattgtaatcagggacaatccgtctgggggcacagtttttgaagtgattttttaatgacaggatcatatttgtgataaatgattgcatggtccttgatgcttgacgtgcaggaatacaaaacgtataataatcggaggatataaggcagaaaatggaggaacgctcatggcattaagcaagaagccggtcaacggcatgaaagatattttaccggaggagatgcagatccgggattacgtgcagcaggtcatcaaggagacctaccgcagttttggattcacaccgattgagacaccttgtatggagaacattgcaaatctgagcaataagcagggcggcgagaacgagaagctgatcttcaaagtgatgaagcgcggtgagaagttaaagatcgcagaggcaaaggaagaggcggatctggtcgattttggaatgcgctacgatctgacggtgccgttagtccgtttctatgcgaacaacgccaatgatctcccgtccccgttcaaggcactgcagatgggcagtgtgtggcgtgcagaccgcccgcagcgcggacgttaccgccagtttatgcagtgtgatattgatattatcggtgagccgagcaatctcgcggagatcgagctgatccttgcaacgacaacgacgatcggcagactcggattcaagaattttgagatccgcatcaatgagcgccgcatcttaaaggccatggcagcgtacagcggtttcccggaggaagaattcgataccgtattcattattctggacaagatggacaagatcggtcttgacggcgtggcggaagaacttgccaaggaaggctatgcgaaggagtcgattgacaagtatctggcgctgtttgagggcgtatccaaggcacagaacggtatcaaatatctggcagacactttacagggctttttggagccggaggtggagcagaatcttcaggagatcatcgacagtgtggaggcggcaaaaacagccgactttaagatggtattcgatccgacgctcgtacgcggaatgagctattatacaggaacgatttttgagatcgcaatgccggagctgggagcagcgtgcggcggcggcggacgttacgacaagatggtcggcaagttcaccggaaatgacgttccggcgtgcggattctccatcggctttgagcgcatcattcttcttctgatggagagcggtttcaccgtgccgatgcagcgcccgaaggtagcatacctcattgaaaaaggctgtacctcggagcaggtatcgaaagtgatcgccagggcacaggaggagcgtgttgctgggaagcaggtgcttgtcgtgcgcatgaacaagaacaagaagttccagaaagagaagctgacagccgagggctacaaggacattgtcgagttttacaaagactgatccggaaatgatctgacagagaacgccataggatgatctatggcgttttttacataatgggaaacttcgtttctattacataaaaaagcttcgcgtggatgtgcacgtttcttaaaggagattacgaacggtataaagtaaaaaaagagaaacagcttgcagatggagggcatatgggaagaattatcggtattgatcttggaacgacaaacagtgcggcggcagtgtgggaaaatggagagagtcatctgattccgaatgcgtttggagactatctgacgcctagcgtagttagtataggcaaagatggcacggtgtacgtgggaaaaattgcaaaggagcgtctggttacacacccggaggatacagtaagcgtttttaaacgatttatgggaacggaaaagatatattcgctcgccggaaaaaaataccgtccggaggaactttccgcgcttgtgttaaaaagattaaaggaagacgcggagcattatctgggggaggagattacggaagcggtcatcagtgtaccggcatattttaacgatcttgcaagaaatgcaacaaaaaatgcgggggaactggcaggatttcatgtggagcgcatcattaatgaaccttcggctgcatcgttatattatcagtgccgaagccagatggaggatgccgtcatgctggtgtttgattttggagggggaacgctcgatgtgtcattagtagagtgttttgataacattgtggagattctggcggtcagcggagacaatcatctcggcggcagtgattttgaccggttgattgcagatatgttctggaagtcgtgcggactttctgaaaaccgcttctcagctgaggatgcggcaattgtgttggaacgtgcggaaaactgtaagtttgaactgaccggtcaggagactgcacagatgtgtgtgacacttgctgggagagaatatcggatggaggtctccagaaaggagctgatcctgcaggcggagccgctgtttgaacggatggcacaaccgatccggcgtgtgttgtcggacgggcagaagagtgccagagaagtagatgcggtagtgcttgttggagggtcctgtaaaatgccggtggtgcaaaagtatttgaattatctgttgcagcgcacggatattgcggttgtcagcccggattatatgattgcgctcggcgcaggagtgtatgcaggcatcaaggaacgcaatgcggatattcgcgatatgcttcttacggatatctgtccgttttctctcagcgtgtcccaatacaacgaagcagatccgaaccgtgatctctgtgatgtgctgattgagaggaacatggcgctcccggtcagcagggagactattatgacgacggcacatgacaggcagaccaaaatgaggtttaaagtataccagggggaagcaatgtacgcggaggacaatctgctgttgggaagcatcacggttccggttcctgtcggaccggaaggaaaagagaaggtgcgggtgcgttatacctacgatatcaatggaattctggtggtagatgtgcacgtcgtatcgacaggacaggaaaaacagctggtgatccggaatgataagatcaaactatcagaagaggaactgaaaaaaagactggagcagttgaataaactgaagattcatccgagagatcttgaggaaaacaggctggtgcttgcgcgtgctgaaaagctgcatcgtgagacaacgggatatatccgggaacagattgatagtcgtgtacagtattttaattattatctgggaagacaggatgtcctctccatcaacaagggcagaaaacagctgaatctgtttctggactatgtggaggagcagtgtctgcaggagacggcatttgagggaacagcagacggtttttcccggtggtatgagagtagtaagcaggcggtcgatgcgcaggatcaggcggattaccgcaaagaggaacaggaatatgaattgtggaggggcggacatctgaccagctagaagaatatgacaatatgggagatactgggaatttcccagactacagatcaaaaacagatcaaaaaagtgtatgctgccagagtaaagagttgtcacagggaggaaaagccagaggagtgggcagtgcttcacgatgcttaccagcgcgccattcaatacgcgaaaagacaagagaaagaaagtgacctgaacggaagcaggacggttccgagtccggtgaaaccggtggcacgggaaggtataagagagcgggacgcggcgctggagaaggaaaacggacagcctgaaaccgatgagacagaagcacaatggcaggagtattttgcacgcattcgtgccggacaggagagaagcaggaaaatgctgacagaggagttgccggagcggctgcgaggtctcacattgcagggggaaggaacccagaagaaacgctgggaagagttcctgcaatcggagttggcgattaccctgtacaaagaaccagagttctggagacaagttggtgaacatgtgagggcacaggagtggtcggaggaagcatgccgctacataggcagacgcgtggaagacataaaatatgagtttaacagtcgtgattatccggaattatggcgtgtgctggatgaacttgagaggatttgtctggaggaggcactgaaagatccgttacggagaacaaagataacgctgcgtggatttggattgacgatccttgtgttcgtgcttatcggagtgtttgtcagaattatttagaacggataaaaccgttgaaaaatcgcgtttcatggtgtaagataaaaaaagcgccggacaggctgctgcccggacagatttgaagaacatttttagattgatacaagggagttaagaaaatgacacagtcgagaacacataactgtaatgagctgcgtctttccaatgcgggagagaaagtaacgctcgtcggatggtacgagaatctccgcaaggtcagcaagaacctgggatttcttattttaagagatttctatggaacgacccagattgtcgttgagacagaagagatgatggagaagctggacggagtgaacaaggagtccaccatttccgtaacaggaaccgtcagagagcgctccaataagaatacagagcttccgaccggagagattgaagtcgtgccggaagggatcgagatccttggaaagtgtatctacaatgcacttccgtttgagattaaccagtccagagaggcggatgagaacaccagattaaaatatcgctatctggatctgagaaatccgtcggtcaagagcaagatcgtgctcagaagccgcatcgtggcagagctccgcaataagatgaacgagctgggatttttagagatcacgactccgattctgacctgctcttccccggaaggcgcgagagattatctggtaccggccagaaatcatccgggcaagttctatgcactgccgcaggcaccgcagcagttcaagcagattttaatggcgtccggattcgaccgctatttccagattgcaccgtgtttccgtgatgaggacgcaagagcagaccgttctccgggagagttctatcagctcgatatggagatggcatttgcttcccaggaggatgtgttctctgttgtcgaggaggtactgccgccggtatttgaaaagtatggtgtatacaagactgcttccaaggctccgtttgtgcgtattccatatctggagtccatggacaagtacggcaccgacaagccggatctccgcattgatctggtattgcaggatgcgacggacgtcatggcagactgcggattcggtccgttcgagggacagaccgtaaaagcggttgtcgtggacggatttactgcgaccagaaaagtgatcgacggaatctgtgccgaggtggaagtgcagacagccaacaaggcttactggttcaagctggatgagaacggcgaatttgtgggaggtatttccaagttcttgcaggagcgcaaggagacagtcattgctgccctcggattaaagccgggtgactttatcggtctgaccgcaggcaagaagctggcagcgcagaagaccgcaggcgtactccgcagactgcttggcgctgcgagcgagaagcacatgaaaaaggattgctacgaattctgctggatcgtagatttcccgatgtatgagatcggcgaggagtccggagaactggagttctgtcacaacccgttttccatgccgcagggcggtatgaacgcactctgcaacgaggagccgctttccatccttgcttaccagtacgatctggtgtgcaacggcgtagagctttcctccggtgcggttcgtaaccatgacccggagatcatgatcaaggcatttgaactggttggtctcggcgaggaggatgtgaaggcaaaattccctgccatgtacaatgcattctgctacggagcaccgccacacgcaggaatcgctccgggtgttgaccgtatgattatgctgatctgcggcgaggagagcattcgtgagatcatcccgttcccgatgaataagaacgcgatggatatcatgatgggagcaccggcgactgtagatcagaagcagctggacgacgttcatatccgcattcagatgccggaagaaaaatagcgtaaaacgacagcaataaagacacaggcttttggacagactatctccaaaagcctgttttactctatataaagtagaaaacttgaatgaaaaaggagatcacagagagaatatgggaaaaagaaccggaaagaaccgtaaaacgaacggcagggcaggatacgggaagcgcgtggctgcggtgggaatgatgttcgtgatgttgttttcttttgccgcctgcgggaagacgagcacttctgaggaagcggaggcactgagcggaagctgtattgacattttaaacaaagtttacgaaacggccgatctggatgaatccatgcgggaggccatgcaggattatgagatgacgacgatcgatgcggatatggaagaatatgtgctgggcacagatgagatcacatatactgactcggcgtattctgctccgatgatgacgtcggtggcatatcagtgcgttgtgctgcgcgtgtcggacggaaccgatgtgccaaaggcaaaacagacgcttctggacaatgccaatcctgcaaaatggatctgcgtggaggcggagagtgttgcggtggagagcatcggggatgtgattttatatgtcatgggcttcgacgaggacgtgtctgcaataaaagatgcatttcttgcattggacgaatgagatggatgcaattaagaaacaataagcttttgatgtgagaaatatcagaattgactgataacactataaagagataaaaaggaacgatgagagaggaaatcctggttcgcggacagagaatgacagttctgtcttaagaccgggattttttatataaaagcaaccaatgttttgtaataaacagtatataacagttgacaacagttctatactgttatatactgtttgtcgaaggaaaacctacatactgcgcagaggtggaggagaatacaaaaaaatgaagataattgtggatcacacatcgatgcagccgatctatgagcagatcgtagagcagataaaaaaacagatcctgcagggaaccctgcgggagggagcgccacttgacagtgtgagaatgcttgcaaaagatcttaaggtgagcgctctcaccgtaaaaaaggcatatgatgcccttgaggaggagcagctgatcgcaacggtgcatggcaagggcagctttgtgctcggggtgaatccgtcactgcttgcggaagaacagaaaagagagatcgagcagcggatggaacagctggtggcgaaggcgcgggcgtatggcatgagcgacgaagaactgcgggcggttctggaattgtttttggaagcataggagtgcaatcacaggaatggagaatcatatgaatgatgggatggtgcaactgaacaaagtaacaaaggcatacgggtcgtttcaactggactgctccatggaagtgcagcccgggatggcaaccggatttgtcggggcgaacggagcgggaaaaacgacgacatttcagattctgctggggctggtgccgccggagacgggtgagataaggatcttcggaaaaccatatacagaactgactgcaaaagaccgggagcggatcggggtatcccttgcggattcgggcttcagccagttccttaccgtccgggatgtaaccgccattctgcggaatctgtataccagatttgatgaggccaggttcctggaaaaatgtcagcggtatgaacttccggcgaacaaaaaaatcaaagatttttctaccgggatgcaggcaaagctgaaattgctgattgcgatgtcacatgacgctgacctgctgattctggacgaaccgacgctgggactcgatgtgatgtccagagaggcgatgcttgaagaactgcaggaatatctggattcggagggaaccggcggagcaccgagatctgtcctgatatcctcccacatctccagcgatctggaaaagttctgcgatgatatctatatgattgaccgggggaagatcgtgcttcacggggagacggatgttcttctggattcatatggtatcttaaaagtggatgaacggcagtatcaggcgctggatcgtagatatctgcttgccggaatgcgggaagcgtatggttatcgcctgctgacgaacgagcgccggtattatcaggaaaattacccggatcttgtgatggaaaaaggcagcattgatgatattctgattttgacagcgaggggggagaagctatgaaaggattactgacgaaggattttcggattctggcagggcagaagcggtattttacgattatcattctgattgcggccattttcctttgcagcggtcagccggcgcagatcattgtgggatattgtaccatgttcggcatgctttttacagtaaacacgatctcgtatgacgaattcgatcacggctatctgtttctgttcacgcttccggtgaccagaaaagattatgtgctggaaaaatatgtatttatgctgctgtgcggcggtggtttctgggcagtttccgcagcggccggttttgtggcggattatatccgtggagatgtggtgtctcttttagaatggctgatgcccatgttccttattttattagagatgacaatttttctggcagtcatgcttccggtcagcctgaaatacggtatggaaaaaagcaggacagcaaccatgattctggggtttgcggtgcttggggctgcaattgcagcaaggaagcttctgccggagaattttgcgggagggctgaggtggtctgcgcagttaaatcctgcggccgtgactgcggtagtgtttctggtttccctggccacattggcggtatcctttgcgggcagtgtccgcattatgcaaaaaaaggtattctaaggattgccactttacaaatagtgcaaaaaataggataatggtatcacttaaaaacaacattttacaatagatgggattgatcatttatggaaatagaacatatcggtgataacaaaatccgctgtgcactgacggaacaggagatcgagagtctcggatacgatattgatgagatcattgcgaacagcgagatcacgcaggaattcatgcatactgtcttagaactcgtcgaggaacaggaacatattcagatggagggcatctctccgatggtgaaggcggagcttttgcaggatcacagtatggcgatcacttttggcgcagacaaagaggtgtcactgagggatctggtgaatacggtcagtcatatgatcagccagctggatccggacgctgcatcagggaaaacggccaaggcagaggaggggaacgcacaggccgcagcagatacggcggatacggcagccgctgcgggaacgcataagcgcaccgacccgatgatctgtgcactgcgcttttcttcctttgagaatatgcgcaggatgagcctgcttgcttttcgcgggaagattccaaagagcagtctctacaagatggacggcgcgtactatctgattctggattttacgggatttgccaaggaggagatgcgtccatttgcgttcggaacgatcgagtatgacgatgcgcactactccgatcaggggcacattgcacatatcagagagcagggaatttgtatcatgaaaaagcaggctcttgaaatgctgatgcagttgtgagaaatagataaaagccgttttgtaaataggcaaagtcctcaaatccggtcacaaaatttggtaaaaatgccgaacaacttcctgatgcattttccactatatatgctatgatggtagaggtgtgtgtacaagatatatacaccaagaagagaatagcacagaagaaggcgggggacgccggtgtgcggaaagtggagaagttatgagcagagagcagatctgggagcttgaggagaacaaacgcagcctgttaagacaggcctatcggatgaagcaggaatgtccgcatatgtcgccggttggacttgagtatgaaatgtatgccgcgattatgaaagaagtgcgggagattacggcgagattacagctgtctgcagaggcttaggatggcgttacaaaagaaaatcaatataagaataaaaaagagctttcatccgggtttgcagatgaaagcttttttgatatgataaggagaggatgcggaatgaagagacagaagatgcggacggaacagaagtctaatgtgaaaaacagtgtgggaagacttgtgtttgtaggattatccctgcttttgcaggttttgtggattttgttgctgtttttgcggttgaatgcatattctacggcaatcagtttatgctttagtgtaggagcatttcttgtggcgttaagcatttacgccaagcacgagaacgctgcgtttaaaatgccctggattattctgattctggcgtttccggtgctggggctctgcatatatctggtgtttggacacaagaatgtggtcgcaaaggcgatgcgcagacgctttgagacgattgaaccggtgctgtttgagcagattccccaggatgaggcagtgcttgggcggctggaggagcaggattttgcggtggcgaaccagtgccgctatatcaagcggtttgggcattatccggtgtaccggaataccgatgtgacattttacccggatgcggcggagggacttgcggcgcagctacacgatctcgcgtcggcagaacattttatctttatggaatatcacgcgatcgaggaagcggaggcgttcggcaggattaaggacgtgctcgccgagcgcgcggcacacggggtggaggtacgcctgttttacgatgacgtcggcagtatcggctttatcgatccgggctttatcaagcgcatggaagccatcggcgtagagtgcagggtgttcaatccggtgcttccggtcttaaacattttcatgaacaaccgcgatcacagaaagattacggtggtggatggaaagatcggctacacgggcggctacaatcttgcggatgaatattttaatatcacgcacccgtacggaacctggaaggataccggaatccgtcttgcgggagatgcggtggcaagcctgactgtgacatttcttcagatgtggaatgccacggcggaggcggaccatgagtttcagacgtattttccgaagctggattaccgcgcggcagacaccggttttgtacagccgtatgcggacggccccctgacggacggttattttgcggaggatgtttatttaaatctcatcaagagtgcgaaacactttttctatgcggcgacgccgtatctgattatcagcgatgatatgacgagggaactgtgtctggctgccgagcgcggcgttgatgtgcggattgtgacaccgggaatcccggataagaagttagtgtatcagacgacacgctcctactatgcgcctctggtgcggcgcggcgtgcgtatctatgagtacacgccgggatttatccatcagaagcagacactttgtgatggggagacggcgacggtcggaacgatcaattttgactatagaagcctgtaccatcattttgagaacggcgtgctgctgcatggctgcggggcgatcggtgccattggagaggactttgcgcagatatttgaggtgtcgcgcgaggtgacggaacagtataagggaaagcggagtatggggcttcgcatcatacagtgtattctgcggttgtttgcaccgctgttataggagaagaaaaatgcgacgcattgcgtctgcggaacggaggtttttatgctgagagagtggaaagagccggtaagacccggggaagaggaattaaagatgcgccttgcggcagccagggaaaagcttgccgcccagcagcttctcatcaaggagcagaaagtgccggtactggtgctgctggaaggctggggaacggcgggaaaaggctactgcatcggtcagatcatcgagaatattgacccgcgccattttaaggtggagtccatggagagaaagaccggggaggaagagcgcaagccgtttttataccgccattttacccggattccggaggcgggaaagtttgtgttcttagattccggctggatggatgaggtggtggaagagcgccttcacggggagctttccgaggaaaaatatgcaaagcgcatcgagagtgtgcggcgctttgaacgtcagctgacggataacggctaccttgtgatgaagtttttcctgcatatctccaagaaggagcagaccagacggatggagcgcctcacggatgaaaaggacaccgtctggcgtgtggggaaaaaggatctgtggcagaacagtcactacgagaagtgcatggatgcgttttcttcctatttgaagagcacgaatatgccgtccgcaccgtggtatattgtggatgcaaagtcgaagaagtggacggaattgcaggtgcttgagacgctgacgcagggaattgacattgcgcttgacaaccgtgatatggcggttccgcttctgcagaatgtattcccgttagagcgcatgccgcttctctcggagataccgctcgataagacgctcgatgaggagacgtaccgcaaggagttaaagcatttaaaacagcggcttggcgagctgcacaaccgcctgtaccgcaagaaggttccggtcatcatcgcctatgagggatgggatgctgccggaaagggaggcaacatcaagcggatcaccagtgcgctcgacccgaggggctatgaggtgcatccgatcgcaagcccggagccgcatgagaaggcaagacattatctgtggcgtttctggacgagactgccgaagaccggtcacattgcaatcttcgaccgttcgtggtacggacgtgtgatggtcgagcggctggagggattctgcacggaaaacgactggatgcgcgcgtacaacgagatcaatgaatttgagaaggagctgcatgactggggagccgtcatcatcaagttctgggtgcagatcgacaaggatacgcagctggagcgctttaacgagcggcagaacacgccggaaaagcagtggaagatcacggaggaggactggaggaaccgggaaaaatgggatcagtatgagacggcagtcaatgagatgatcacaaagacgagcacgacctatgcgccgtggcatatcctcgagtctgtggataagaagtacgccaggatcaaggcactccggatcgtgattgaggagctggagaaggcactcgattaggttctgttttagaatgacagaaatatgcaaattatgccatgcgtggcaatacaatttcgccctctgtcttactataatattttcagaaggaatgaaaataggaaggtaagacagggggattttttatgcagtacggacattttgacaatgagaaaagggaatatgtcattgaccgcgtcgacctgccggtatcgtggacaaattatctcggcgtgaaggatttgtgcgtcgtggtcaatcatacggcgggcggttacatgttctatcagtctccggagtatcaccgggtgacgcgttttcgcggaaatgcggtgccgatggaccggccgggacattatgtgtatctgagggatgccgaggacggagactactggagcatatcctggcagccggtgggcaaaccgcttaatcaggcaaagtatacctgcagacacggcatgagctacacgacctatgagtgcgattacaagggaatcaaggcaagccagacgctgatggttccgatggacgatgcggtggaactgtgggatgtgcgtcttaagaacaccacagacaaagagagaagattatcggtattttcgtattgtgagttctcgttccatcacattatgattgacaaccagaatttccagatgagcctctactgtgcaggatcatcctacgatgaaaatatcatcgagtatgatctgttctatgaggaattcggctatcagtatttcgcgtcgaatgtgacgccggacggatttgactgtctgcgtgacagctttctgggagcataccggacggaagacaacccgattgcggtggagtgcggaacatgcagcggttctcacgagcttggaaacaaccactgcggaagcttacagaaggatcttgtgctggcgccgggagaggaagtacggctgatcttcatgctcggagagggcagccgcgaagcgggaaaaaagatccgggaaaaatattctgacatggcaaatgtggatgcggcgtatgcacagttaagggagtattgggaaaacaaatttgcacagctgcagatcaggacgccgaatgagggaatgaatacgctcatcaatacctggaacctctatcaggcggaagtaaatatcatgttttcgcgttttgcatcgtttatcgaggtaggtggccgcacgggtctgggataccgggatacggcgcaggatgcaatgacgataccgcactccaatccggagaaatgcagacagcgcatcgtggaactgctgcgcggactcacaaccaaaggctacggactgcatctgttctcgccggaatggtttgacccggatgcaaaaaaggaaaagaaaaagccgtttaagtctccgacggtcatcccgacagtgaacgcgaaggacattgtgcacgggctggaggatgcctgctcggatgatgcgctctggctggtgccatccattatcgaatatatcaaggagacgggagagactggatttgcagatgagaccgtgacctatgccgacggaggcgagggaacggtatatgaacatatgaagcggattttggatttttccgcggaacaggtcggcgcaaccggaatctgcaagggactccgcgcagactggaacgattgtctgaacttaggcggcggagagagcgcaatggtgtccttcctgcattactgggcgatctgccacttcctgcagctggcagaatatctcggacgcacggaggatgtggaaaaatatcaggcgatgcgcgagcgggtaggaaatgtctgtaacagggaactgtgggataaggaatggttcatccgcggtatcacaaagaacggaaagaagatcggaacatcggaggatgcggaaggaaaggtacatctggagtccaatgcatgggcagtgctttccggtgcagccgatgtggaaaaaggaaaacgtgcgatggattccgtggataagtatctgtttacgccgtatggaattctgctcaatgctccatcgtacaccgtgccggatgacgatatcggatttgtgacgcgcgtttatccgggattgaaggagaacggctccattttctcccatccgaatccgtgggcatgggctgcggagtgcgtgctgggacgcggcgaccgtgcaatgaagttctacaacgcactgtgcccgtattatcagaacaatatgattgagatccggcagtcagaaccgtattcgtactgccagtttgtggtcggaagagaccacacagcattcggacgggcacgtcatccgtttatgaccggaagcggcggctgggcttatttttccgcaaccagatatatgcttggcatccggccggattttgaacacctgaccattgatccgtgtatcccggcagactggaaggaattttccgccgtcagacgctggcgcggggcagagtatgatattcacgtggaaaacccggacggcgtgatgaagggcgtgcaggaattgtatctggacggagagaaggtcgaacgtatcccagtgatggcacagggaagcagacatgacgtcagagttgtgatgggatagcacaggaaaagaaaggggacattgatatgatcaaatttggaaccggcggctggagagccgtgattggagacgattttacaaaggcaaatatacagcttctggcgcaggggctggtcaacaaaatgaagagcgagggtgtgaccgagcagggcatcgttatgggatatgaccgcagattcctctccaaagaagccatgcagtgggcggcagaggtatttgcagcggcacagatcaaggcatacctgatcaacaaatcctcgccgacaccgcttgtcatgttctacgtgatgaagcatgattttccgtacggaatgatgattaccgcaagccataacccggcaatctataacggaatcaaggtgtttactgcgggcggccgtgatgccgacgagatccagacgaaggatctggaggactacattgccgacatcgcatcggacggcgtctgcgcggttgcatatgaggatggaaaagcggcgggctatatcgaggagatctatccgctcaatgagtacatagacaatatcattgcatcggtggatatgaaagctatccgcgacgctgatcttaaggtggcactggatccgatgtacggcgtgagtgagacatcgttaaagacgattcttttaactgcccgctgcgaggtggcgacaattcatgacagacatgatacactgttcggcggaaaacttccggcgccttccgctgcaacgctccactcactgcagaattatgtggtggaaaaacagtgtgacatcggtatcgctacagacggagatgcggaccgtatcggcgtgatcgacgacaagggcaatttcctgcatccgaacgatattctggtgctgctgtattactatcttgtaaagtttaagggctggcatggacctgtggtgcgcaatatagcgaccacccatatgctggataaagtggcagagcagttcggagaaaaatgctatgaagtgccggttggttttaagtatgtctccgctaagatgcaggagacaggagccatcatcggaggcgagtcttccggcggtctgaccgtacacgggcacatcaacggaaaagacggcatctatgcggcggcgcttctgatcgagatgctggcagtgaccgggaaaaagctttcgcagatcatggatgatattcacgcagaatgtggggagatccatatggaagagcgtgattataagttcacactggagaaaaagcttaagatgcaggaagttttaatggagcagaagcagctgccggatttgccggaagagattgaccatgtctcctatctggatggcagcaaggtctacttcaaaaatggaggctgggtcatcgcccgcttctcaggcacggagccgctgctgcgcattttctgcgagatgccggatgccgtcgaggcggcggacatctgcaccagatacgagcagttccttgatctgtagagtagaaaaacgccgcatttcacattccattccgtgtcttgccacgctttgacaatccaccgggggaatgtccgacaagcacagacaatgagcggactttctagtgcctctaatcgaattgcttcacagacaatataaaaccgcgcgaaccgaaactcgttgccatctgctattgaaaacatggcagatggcaattcagacatcggcttcgcgcggttatgttttgttcagcaattcgataagaggcacacgaaagtcctaaaattgtctgcagcttgcggacatctccggtggagtgctcaaagcttggaaagacacggtataactagtccgcgcggcggtgttctgctataatggagagagaaaacggggaggcagccgtgtgaaaatacattttttcgcatgcaggaatggagatttttatggagaaaaagagacgactgtcgtcattgaagaagaaaattatagtatttgtcatcctgtgctggggtgtcccgatcgcggtattttttgcatataccaccagctcctaccggaagggaatcattgagaagacggaaggtctgatggaggatcagttagagaatatggcttcctttgcatcgatccgcatcgaggatgccatcacgctctgccagagaccttcctatgagaagacctgggagaatgcctggaaaaaatacctccggggagactattccagaaacgactatcttcaggatgtctataccagtctgcgcggaaagttctatctggacgagcgttttaatatgtatgcctactactgttacggaaccgaagatccggagagcttttcttcgcgcaccggcatctcgttaaagagttatgtggatgagatacagccttacctcaaagatgtgatagattcggattcggcgtatgcctgcgtgcgggtggtcgacgggcgtatttttatcgtccgcaatctgtacacgacgatggattatacacggtacggtacgctggtggtggagttaaaccgcagcaaggtgtttcaggatgtggataccggtcttttgaatgatatggtggtctgcttcggaagccgcgatgcgcgggttgactttgtgaaaaacgaggagaagagtgacaaggaacagcttttagagcagcttctgcaaaagtatgacggggtgagcagccacacattctcaaaggcggaggacgctacctaccgcgcgtatctgtatcaggagcggcgggatgattttcacatcggcattgtactttttgccagaaagagcgaactctattccgggctgtaccagttctatacgattgttgcgctgatgtttttgctgttgattccgctgtttggctatgtggtgtattttatccgcaggaatatccagcacccgatcgaccggatgctccgcgcttccggacggatggaagcgggagagatgggaatcacggtcgagggagacatgcccaatcaggaatttatgcagatgaaggagagcttcgacagcatgtccgcgcaggtgaagtatctgtttgattccatgtacagtgaaaagcttgcgcgcaaggatgcacagattcaggcgcttcaggcgcagatcaatccgcatttcctgaacaatacgttagagatgatgaactggcaggcacggatgtcgggagatacggtcgtgtctaaaatgattgaatcgctgggaaccgtgcttgattaccggatgaaccgcgccaatgtaaaggagattcaccttgcggaggaactgcagtgcattgatgcctatttttacattatgtccatgcggttcgggcagagactctcgatcgagcgcaagattgacgatgatctgctctatctgatggtgccgccgctgatcttacagccgattgtggaaaatgcgattgtgcatggggtggagacggtaaaaaacggcgtcatccggcttcacgtataccacgatgatgaaaatgtctacttaaaagtgcgcaatacgggcaaaaagatgacggaggaggagctggagcggatccatgctatattggagggcgatgagagcaagcttccgaagaataccggacgccacacctccattgggattcagaacgtgaatcgcagaatccgcctggtatatggggacgaatacggtctgtcgatcgagcaggaggaagactgcatcacggtttcgacgattacgataccgtacgttgaccatgaggatgaaatatcgttaaaagagagaagcgaagcgcaaaatgagttaaagaacatagcaagattgaacaaataatgtcaaatgggtctaatgccttttgtgagttctgctcgtataatatcagtatagcaaatgaaaaacatttgcaggaacaaaaacaaggagggttttgactatgaagaaaaaggtattatccatgatgctggctggcgcaatgacagtgtccatgctggcaggatgcggggcagggtccgatgagactgcaacgacagacaacacggcagccgacacaaagacagagacagccggaacaacagaagcaggcgggggtactgcagaagcatccggaaatccggtgacattaagaactgtgtcgatgttcggaggaaccgatccgaataaggagacctacgaagcaatcaacaaagagtttatggagcagtatgactacataacgatcgaagacaattcacagacatccgatgaggaatggaaagcagcagtcaatgcggacttctccgtaggcaatgagccggatgtcatccagttcttcacggatgcaaccgcagacagcatcattgcaacggataagctggtatcaattgaagacatccgcgcagaatatccggactatgcggcagacacactggattccgcattacaggcagcagcaaacaccgacggtgttgagcgtgcggttccgacaaccggatactgggaaggcttatactgcaacaaggatctgttcgaccagtacgatctggaacttccgacagactgggcttccatggagacagcgattgagacgttcaaggagaacgacatcattccgattgcctgctcgttaaacaacgtaccgcattactggattgagttcctgatgttatatgcatccggcgtggatgagtatacttccattccgacgagcgcgccggaaggatgggtaaagggtcttgagatgtttaagacattaagagatatgggggcattcccggaggataccgacaccgttgatgacgcatacacaggccagttattccgcgacaagaaagctgccatgcagttagacggttcctggtatgcaggaaacatcgaggataccgacaacaccgttgtgatcgcattcccgggtgttccggatcagaaagcagaggcgggctctttggtaggcggtatctcttccggattctatatcacaaagaaggcatgggaagatccggacaagagagatgcagcagtgaaattcgtcatggcacacacctgccaggcaggcgttcagagatactgggaagcaaccggcgctgtgtcccaggcagctgttgaggtaacaccggtagagggtgcaacaccgtttgcacagtctatcgcagagtacacaagcaacgcaacggcgatcgtggcaccgacagattccagaatcggcgatgcatacaagacacttgtggtagagattgtcaaggtatctacaggtgctatgtcggcggaagatgccatcaacgaggcactcacattggtgcagcagtaaaatcagatacagaaaacagtatgacggaggggctatgcccagcggccccttcgttttttgcacccaaaaaacagttatttttatgatagaaaggtggaagaaagatgttatataagaaaaaatggccgcttgtggtgtttttggtaccgggtttattgttcatgttagtctttctttacataccgttcgtgcagaatattaagaacagcttttatgatatgacggcaatcatcgagatgccgggaactgaatggaagtttattggatttgaaaattacaagaaattgtttacagacccggatgtgaggacggcactcgtcaattccctgaagatgatggtgctcacggtgatttttgaggtcggaatcgcatttgtgcttgcggtaatggtttcacagataaaaaagcttcagcagttattccgtacggtgtacttttttccggtagtgatttctgcaacggcgattggtctgttgttcaaattattctacaactataacggtggtatgctgaatcagattttagagagcattggagcaaagccggtcaactggctttcccccagcctggcatttatcatggtctgtatcccgacgctgtggagttacatcggtttttactttgtcattctactcacggggttaagcgatattcctgacgacatatatgaagcggcgtccatcgatggatgcagccgctttaaacaggtattttatattacactgccaatgatgaaaccggtattctttacatcggtcacactggcggtaacgggagcattaaaagtatttgatcttccgtgggtcatggtgccaaacggcgcgccgcagggactgacccatttccttggaacgtatatgtaccagcagaccttcggactgaacaattatgattatggttctacactggcggtactgatcgtggtgctcggcattgtggtgtcgaaggcagtcggctttcttacggcagatgcggacgacaaagaagcgaaaaagcgcgcaagagcagagaaaaagaagggggtggcttaaatggatgcagcagtaagtgtaacgacagtcagaaaaaaacacaggagaatcggagccggtacggttgtcatttatctcgtactgatcttctgggcggtgctcaccattttcccgtttgtgtgggtggtgctgaattcctttaaaccgtccgcggaggtgctccgctcctccttctcacttccggagacgttcacctggatgaattatcagacggcatttgagcggttaaacgtcttaagagcctataggtacagcttcgtgatctccggcacggtaacggtaggcgttatggtattcgcgtcgctgatggcattcggacttaccagatatcatttcaaaggcaaggagctgatccgcagcctcatcgtggcaagtctgatgtttccggtattttccacgatcattccggtgtttaagatgatggtggaatgggggcttctgaacaaaagcattgcggttatcctgccgcagattgctggaaacttaagctttgcgacgatcgttatgaccggtttcatgcagagcatcccgctggagatggaggaagctgcctacatggaaggcgcagatgtatttaaggtatttggaaaaattattgttccgctttgcagaccgtcacttgcaacggttgccatctttagtttcctctggtcttataacgacctctttgtacagaaaatcatgatgcgtgacccgaccaggtatccgatctccacactgttagaacagatcagttcccagtatggaaccgatttcggattgatggcggcgtcggttacgatcattgtcatcccggtcatgattgtgtatgtgctgttacagaaaaatatcatcaaaggattgacagcaggtgccgtgaaaggctagacttcttggaaagagagcggaatttgctcaagtggaggattggctatgtacaaggtgatgattgtggatgacgaaccgatcatcgtggaagggttatcgaggagcatcgcgtgggaaaagtggaattgtaaggtcgcggcaacggcgcacgacggactggaagggaaaaagattatcgaggagattcacccggatattgtgtttatggatatctgcatgccggagatggacggactggcgatgatcgctgcgatccactcgcagttcccggatctcgaggtctgtgttctgacgggctaccgtgatttcgagtacgcgaaggaggcaatccgtctcggggtgacgcgctttctgctcaagccgtccaacatggacgaactggaagaagccatcggcaagatgtgcgggaacttaaaacggaaaggaattaccggggatgagccgaagcgtgatccgcaggatgaagaagcggcggaagcgcacaaggagagcgcatcaagcagctttatcgtgaagaatgcactgacttacattgaggagaattatacgaagaagctgacgctctgcgaggtggcagagaagacgtatgtgagtcagtggcacttaagcaagcttttaaaccgccacacggggcagagcttttcggatattttaaatcacgtccgtatcgagcatgcgaaagaactgctaaaagatccgtcgctgcgcatcggagatatctccgagcaggtgggatttttagatctggcacatttttcgagggtatttaagaagcaggagggagtctctgccaatgaataccggaatcaggtactgggaaagtaaggtgccggacggctagagtacatagtatccgagcacaccgcacagaatccctgcaagagcgcctgcgatgacgtcgcgcggctcatgaacgccgccgatcacgcgcaggacggcaaggacaacccctaggagtccgagcagaatgccggcggaggggtggacatagaaaatggtggcggcaatgataaatacggaaaagacatgacggctgggaaaagatttcccggccgtatctttttctatggcaggcggaaggccgaacttctcataaggtcttggggcgttaaagatccgtcggaagagcgtgactgcggcaaaggagacggcgggaacgagaagcgcccgcaggaaaaaagcgctgccctcaagaaaaagcagcagcagaaacgccgggtacagcacaaaaataaagccggtcaaggtgtggttgagcaggcataccagccggatgcgccgcggatgtccccgtaagatgccggtgattttctcataggattctctggtcatgagacctccgatccggcaacggcgagcagtgccccgatgaaaatgcagaagtcagagatgttgaagacgatcgcgcgcagccatttcggaccgaaattcagatgaaaatagtcgacgacatgccccttcgtgtagcggtcgtaaaggttgtttaaaccgccgccgagcaggagtgcaacgcccgttttttccagcgcgtgtccgctaaggcgcatcagaaaataggaaaaaatcccgacaacgacaagaatgacggtgtggatgatgcgcagaagatttggcctttttaccatgaaattcaaagccgcgcctttgttataatatttttccaggacaatcctgcccccaagccgcggatggcgcaccttgcgggcatattttttgtccatgtaacgctttaagatgagatccgacaggaataccccgccggcaataatcgcataaaccatgtaaaaatctcctgacaggtattgatgtatgtatcatatcatcttccatggaaaatgaaaagtgatttgcgcttgcctttttttatccctgtttgtgcagttgcctgcaaacccttgaaagggcgttgcctggctgataaagtcaagacagaggcagaaaaatctgcagtaaataacgggcgggagacgggaaggcgtctcctgcctcatgagagaaaggaaaaagggattacgatgaacattatcagagcaaaagactatcaggacatgagcagaaaggcggcaaatatcatttcggcgcagattattatgaaaccggactgtgtactcggtcttgccacgggatcgacgccggtgggaacataccgccagctgatcgagtggtatgagaagggagatcttgacttttccagagtgtcaacggtcaatctggacgaatatcgcggcctggcacacacggatccgcagagttattactattttatgcaggagaacctgtttgaccatgtgaatatcgataagacggcaacgcatgtcccggatggcacaaacccggacgcggcagatgcctgcgcgaagcatgagcagatcataaagtcgctcggcggaatcgatttacagcttttggggctggggaataacggacatatcggatttaatgagccgggtgcagcgttcgagaaggagacacatctggtggatctggcagagagtaccattcgggctaatgcacgtttttttacctctattgacgaagtgcccaagcaggcatatactatgggaataagaacgatcatgcaggcaaaaaagattctggtggttgtctcgggagagagcaaagcagatatcgtctcacgcgcgttcttcggaccggtgacgccggaagtgccggcatccatcctgcagatgcatccggatgtgacggttgtctgcgatgaggcagcgctttccatgtcaccattatagaggtaaagtcagagggaaatgggggatttaagatgagaattaagaatgcacttgtatacacggtagagcacggatttgtggagcgggatgtccggataaaaaacggctgttttgcggggagtgaagcggccggcacggacggggaagagattctggacgcagggggagattacctgattccggggcttgtggatatccattttcacggatgtgcaggtcatgatttctcggacggaacaccggaggcattgcaggcgatcggtgcgtacgagcttcgccagggtgtgacaagcatctgcccggcatcgatgacactctcggaggagacgcttaagacggtgtgtgccaatgcgtatgcgtatacaaagagaccggaggcagagcaggacaccggggcgagactgatcgggattcatctggaaggaccgtttatttccatggagaaaaagggtgcgcagaatccggcttatatccggaatccggatgtagagatgttcctgcggctgcaggaggcagcacacgggctggtgcgtctgattacgattgcaccggagacggacggtgccaaggagttcatccgccggctggcggatcaggtacatatctcggtcggacatacctgcagtgattacgagactgcataccgcgcattttcacagggggcggatcatgtgacgcattttttcaatgcaatgccgccgttcacccatcgcgcgccgggcgtgtttggcgcggcgtttgacgcgaagcatgtcatgccggagctgatctgcgacgggattcatattgatgcttcggcggtccgcgtggtattttccctgttcggggcggagcgtatgatcttaatcagcgacagcatgatggcgaccggtatggaggacggtgcgtattccctcggcggacttccggttactgtgcgtggcaatcttgcaaccttagaggacggaacgattgccggctcggcgacgaatctcatggactgcatgcgaaaggctgtctccatgggaatcccgttagagacagccgtgcgcgctgcaacctataatccggcgagagcgatcggtgcggcggatgtgtgcggaagcattaccgcaggccaccgcggcgactgtgtccttctctccaaggatgacctgtccacgaagaaggtcatcttcggaggaaaggtggtcgcctagcgctcgatccagtcacggacatccgggattttagagagcaccggaagcagtatcagactaagaataatgccgacaacaccctgtacgatgttaaacgggataccggtcgcagaggaagcaatgccggcggcgatagatgcctggtttaaggctccgctgccgagtgcggcaagtccggtttcgtagagaaaatagccgatgaccatgatggcttctccgacgatgccgccgattgcgagcgctgcgtagcgtccctttttcgagtgcagggtgtttttaaaacgatggaagagcagtccggcaatgccgcccgtgagcgccttgataatgaaagttgcaggagcccaggtcacgtagccggagaaaatgtctgagaacatcgagccgatgccggcagcgagcgctccgggaagtgggccaagcacgacgccgcacagcagaacgaagccatctcccggatgaatgtagccgaaggttggtgtcgggatcttgatgatcatggtcgccacgcatgtcatggcggcgagaagggcagcagttaccatttttttaatattttgatttgtcattaggaagtctccattctgtcagattcatataaaagtttgtatttcaacgttgatgcataagagtataacacaagatggattgataaaaatgtccagttgcgattaaattgaccatgccagtttgccggaatggtcttttttcttgcctgaaacacaaagcactgatacactagagacgatgagagagaagaataagggaggaattttatgaataaaaagtgcagaatcatattgtatgtgctgtcgattgtcatggtggcaggctgtattgctgccgtggcgcggacgaaagggagcacgccggaagtaaaggtgccgggcgaagagccggcagctgtggtatcgggtgaggacacggagcatgcgggggcggatagcggagcggatcgtgcgcctgccagggaggagaatgagaccgcggtggagaccacggaggcggaggagagaacggaagccgcggaagtggccgaagaagcggaagcgggcggtcaggcggaagcggatggcagtacgacgattctttttaccggggatgtcctgtttgcaaatgcgtttaaggcgggttatgatgcggacggaatcaagggcgtggttgcaccggaactgctggaggagcttcgggcagcggatattctgatggtgaataatgaattcccgttctcggatcgcggcacgccgatggcggacaaacagtttacattccggtgcagtccgggctatgtaaaggcattaaatgagatgggcgtggatgtggtatcactcgccaacaaccacacacttgattatggaagggaagcgctctcggatacgtttgcagcgttagacggtgccggaattctatatggcggcgcgggcgattccgcggagcgggcaaagcaggtgcaggtaatcgaagtccacgggaaaaaatacggatttatcgcggtatcccgggttgtcccgacggcggactggaaggtggaaaatgcagtgccgggactgtttagctgctatgacaccacggctcttgtggaggtaattaaggaagcgagggagacctgcgactatgtggcggtctatccgcactggggcgtggagtaccaggcatatccggaggcgaaccagacacagattgcgaaggcgtgtatcgacgccggggcggatgtggttgtgggatcgcacacccactgtctgcagggggtctcctatatcgacgggaagccggtattctacagtcttggcaattttatcttcgggcagagtatcgaccggtcggcgatgcttgaggtgacgatcgacgccgcggggcgggcatcctaccggttcgtgccggtgtatgcggcgggaggcgtgacatatcctgccgaaggcggacaggcggagtcggttttgaattatctggacggcatttcggaagcagctgtggcatcggatggaaccgtgacagaagattaactaaaattagtttacaatcagtttaaaaaagtttataatttaaagcaagaaagcttccttctgcgcggcagaagaatatcagtaaaaggagaagaagagatatgagttacatggagacttacaaagagtggtgcacaaacccgtattttgatgagaatacaaaggcagaacttgctgcaataggggacgatgcggcggagattgaggatcgtttttaccgtcagttagagtttggaaccggcggactgcgcggcgtgatcggagcgggaacgaaccgcatgaacatttataccgtgcgtcaggcgacacagggactggcgaactacattctctcccagaacggacaggagaagggtgttgcgatcgcccacgattccagaatcatgtccaccgaatttgcggatgaggcggcgctctgcctgaacgcaaacggcatcaaggcgtatgtgttcgacagcctgcgtccgacgccggagctttcctttgccgtgcgtgaactcggctgtatttccggaattgtgattacggcgagccataacccgagagaatacaacggctacaaggtatactgggaggacggagcacagatcacaccgccgcacgacaagaatatcctggcggaagtggcgaaggtgacatctttcgaccaggtgaagacgatgaagaaagaagatgccgttgccgcaggactttacaaggtcatcggaaaagagatcgacgatcgttacatggaggagctgaagaagcagtcgatccatccggaagtcatcaaggagatggcgaaggacattaagattgtatacacaccgctccacggaaccggtaaccttccggtgcgccgcgtgttaaaggagcttggattcgagcaggtgtacgtggtaaaagagcaggagctgccggacggtaatttcccgacggtatcctacccgaacccggagtccccgaaggcatttgaacttgcgttaaagctggcaaaagaagtcgatgcggacatcgtgctcgcgacagacccggatgcagaccgtctcggcgtgtactgcaaggacacaaagaccggcgagtatgtgacatttaccggaaatatgtccggtatgctgatcgcagagtacatcttaagagagaagacggcgatgggaaccatgccggagaacccggcgctcgtggagacgatcgtgacgacagatatggcaaaagcgatcgcggcagcctacaacgtgaagctgatcgaggtgctgaccggatttaagtatatcggagagcagatcaagttcttcgagcagcagcatacctatcactatgtattcggactggaggagagctacggctgtctggcaggaacctacgcgagagacaaggatgcgtgcgtggcggtcatgatgctttgcgaggtggcttcctggtgcaagaagcacggcaagaccctgtgggatgcaatgctggatatgtatgagaagtacggctattacagagagggattggagacgaagaccttaaagggaatcgacggtgcggcacagattcagtcgatgatgagtgagtaccgcacgaacccaccgaaggagctgggcggtcatcgggtactggcggtgcgcgattacaaggaggacaccagaaaggatcttgtgactggcgaggtgacaaagaccggactgccggcatccaacgtactttattatgaactttccgataatgcgtggtgctgtgtgcgcccgtccggaacggagccgaagatcaaatactactttggcgtaaaggggacttcccttgcagacgcggatgcaaagcttgcggcattgaaggaagatctgttgaaataagaagcgggagatggtatgggagcaattcattattacgaaaaagaacgggtttttaaactggatacaccacataccagttatctgatcggtatcgtggatgaagaaaagtttttgggacatatctattacggcgcaaagatcacggactatgacgtccgtgcgctgatgcgcaccggggaggcaccgtttgttccttcacagaacaaccgcgaccggagctcttttctggatgcgtttccgatggagtatccggggcacggcgtcggcgattacagggagagtgcgatttccgtatcggacaaaaacggcaatacggcggtgcagccgctttacagggagcataagatctatgcgggcaaaccgggacttccgggacttccggccacgttcggcagcgaagaagagtgtgagacgcttgagattgtgctggcggatgaagtgctggatcttacggtcacattgtactacacggcattttatgacgtggatgtcattacgcggagcgtgcgcgtgacgaaccatgccaaagaaccggtgtatcttacgaaggtattttctacggcgttggatcttgacgcggaggattaccggatgctgacgctgcatggttcctgggcgagagagcgacagatcgaataccgccagatcggctacggaaaacagtctgttggctcctgccgcggtgaatcttcccatcaggagcacccgttcgtggcgctggtgtccgcaaacgccggacaggagcaggggcgcgtgtacggattccattttgtgtattccggcaatttcctggcgcaggtggagaagaaccagtttgattccctgcgcgtggtgctgggaattcatccgcaggattttaagtgggaattaaagcagggggagacatttacggcaccggaggttgtgctgacctattcggatgccgggcttggcaggatgacgagaacgctgcatgatctctaccggaagcatctgatccgcagcccgtataaggacagggagcgcccggtgctcatcaacaactgggaggcaacctactttgactttgacacggagaagctgcttgcgattgcgagagaggcgaagaaatccggaatcgagatgctggtcatggacgacggatggttcggccaccgcaacgatgacaacacaagtctcggcgactggcaggtaaacgagcagaagattacgggtggattaaaacggctggtcgatcaggtgaatgagatcggattaaagttcggcatctggtttgagccggagatgatctcgccggattcggagctgtaccggacgcatccggactgggcgattgcccttccggggagaatgccgtgccggtcgagaaatcagtatgtgctcgatctctccagaaaagaagtgcgggattatgcgtatgagtgtgtggcatccattttgcgcagcgcgaacatcgcttatgtcaagtgggatatgaaccggcagctgaccgatctgggaagcggtgtgcttccggtggaaaagcagggagaattgctgcatcgctatgtactgggcgtctatgaattacaggagcgtctgatcaccgaatttccgcagctgcttctcgagaactgctccggcggtggggcgagatttgacccgggaatgttgtattacagtccgcagatctggtgctccgacgacacggatgccatagagcgcttaaagattcaggagggaacggcgctgctgtatccgctctctgcgatcggcgcgcatgtgtccgactgcccgaaccacacggtgggacgcgtgactccgtttgagaccagaggaaatgtggcgctggcgggtacgttcggctacgagctggatgtgacaaagcttccggaggaagaccgggcgaaaattccggggcaggtggcgctgtaccacaaatatcatgcgctgatacgaagcggcgactattaccggatcgcttcctattcgcagaatgattcgtttgactgttatgaggtggtggcaaaggatcagtcggaggcgctgatcacctttgttcaggtgcttggcagaccgaatgtgcacagcagacggatccggataccgggacttgatgagaagaaaaaatatcgtgttgagacaacgggggaagtgtactgcggagataccctcctgcatgcgggactgaatgttccggcgatgtggggagatttccagtcggcactgatacacttatccgaggtgcctgatgaacagtagttggaggatgaaaaaatggcaaaagcggtaaagctggcagatattgcgggacagcttggcgtgagtacggttaccgtatcgaaggcgctgtccggacagaaaggcgtcagcgaggaactgcgggagaagataaaaacgcttgccgatgagatgggatacaaacagccgtccgccaggcggcgcgaacacgcggtaaaaagctataatatcggtgtgctgattgccgagcactggctggataagtatgattccttctatctgcagatgtatcagcaggtggcgacgcgcgcggtggcgaaggaatgttttacgctgatggaagtggtcagcgcacagatggagactgcctgcgagatgccgaagcttgtgcaggagcagaaggcggacggtctgattatcatcggacgcctgacgggagaatatctgaagtttttgaatgaaaaagcaaaaattccgcttctgtatatggatttctgtgacgagaagacagatacggatgcggtgatttcggacagctattacggtgcttaccgcatgacgaattatctgttcgacatgggacacagggagattgcctatgtgggaaccctgcttgcaacgggatccatcacggaccgctatctggggtatacgaaatccctgatggagcacggcgttgcggtgaggggggactggacgatcgcagaccgcgacatccatacgggcaagattgatatggaccggctgttgcagctgccaaaggagatgccgacggcttttgtgtgtaactgtgatctgacggcgagttttctgatccgcaggctgcatgagcacggataccgtgtgccggaggatatatcggttgtgggatatgacaattatcttttcccgggactctgtgatgtggcgatcaccacttatgaggtggatatgaaggagatggcgagacagacggttcacacgctgatcaagaaaatggcaggcgaaccgtaccgccagggaatctgtatcgtcgagggacatatggtcacaaaggacagcgtaaaagccagaaaaaatatgggttagtgcagggaagactgccggaattgcagaggtgtgattccggcatcttttttgaacagattgataaaatgtgtcgtgttttcaatccctacggcggcgctgacctcacggatggtgagggttgtcgtgcgcagcagcgtgcgtgcggctttcagccggacccggttcagatactggattggcggaacaccgatgcagtctgaaaaatcatggcagagccggtagcggctgactccgagagaactctcgagcgcggcgagagagtgggaatgtgcgtaatcggtgtcgaaaatctctttcatgtgtgccacatgcgcgggaagggaaggcgtcgatgcagcacggcgggaagcggcgagggaggacaggacaagcgagagcatggcggtcagatgaagcgaggaaactggttcatcggagagcagctcgcgggagaggtagggcagaatacgccatacgatgtcatccgcctcggtccggttcgtatgaaaaatgcggtcgtccgcacacaaaaacggaagatattccgaaaaatactctgtggacagataaaaacagtggtagcagaaaggggtatgcgtcgtggaaaaccggtatgcggtctgatccggaagaagcatgagatcccccggtgcaagctggcaggattccggctcctgcacagcgtcgccggcagtcgttaaagtgccgcttccggattcgacatagagaaagaggaggtacggcagcgcatcccgcgtcagacggacgggggacgcgtagctgatgcgccctcctgcagggacaaaacggttgtgtacagccgatgtgtcctcgcggaaaacgaaagccgggtcgtctgaaagatcggaaaaacgaatgccgtttccggctgccccggagaagtgataagcctgattcaggcgtgccttgatcgtgatgggttccataagaatcggtcctttctgcataactatcctatattatagcggaactattttgcaatacaataggtttcttgattattaggttaaaaaatagcaaaaattaagtaattaaaattaaattaagaggaaaaagagagaaaaagaagaggctaaaatatgaaaaatgactaaaaacaggatataaaatttgtataacatgtggaaaatgcaggaaaacgcaagaaaataatatattatgcaataatatgtgatgactaaaaatagaaaaaatatataattaaattaagctacaaaatgagctataaaaaaggaggatttttattatgaagttgaaaaaagttctggcagtcagcctggcagcagcaatgactttgagcatggcagcatgcggcggcagttcatctgacagcagcgcagcatctgatgatgcgacaacaggaagtgtggcagcaaccacaactgagagtggggatgcagcagagaccacagatggtgctctgaattatgcaagcatcaaattgggcgaggattacaccgatatcacgacaaccatccatgtattcaaccagagaaccgatatgtccgaggacagctatccgggaaagaactgggaagcttacattgctgatttcaatgagatgtacccgaatatcaccgtagaggttgagacggataccaattattccgacgattccctgcttcgtttacagagcggtgactggggcgacatcatgatgatcccggcagttgacaaggcagacttaagtgagtatttcctgccgtacggtacactcgatgagatggaaggacagatcaagttcgcaaatacctgggattacgacggactggtatacggtgttccttctaccggcaatgcacagggtattgtatacaacaagagagtcttcacagaggccggcgttgcagagacaccgaagacaccggatgagttcatcgcggcactgcaggcaatcaaggattacgattcttccatcattccgctctacacgaactatgcagacggatggccgatggagcagtgggacggacagatcgcaggtacgacaaccggtgattctacctatatgaaccagaagcttcttcacacaaaggatccgttccaggattacggcgataacacacatccgtatgcactgtacaaggtactctacgatgcagtggcagacggactgacagaggatgacttcaccacaacgtcctgggaagattccaagggcatgatcaacagaggcgagatcgcgaccatggtacttggctcctgggcatattcccagatggtagacgctgattctcatggcgaggatatcggctacatgccattcccgatcacgatcgacggcaagcagtatgcttccgcaggcgctgactacagcttcggtatcaatgcggcatcggatgcagatcatcaggcagcagcaatggtattcgtaaaatggatgacagaagagtccggttttgcatacaacgagggcggtatcccgatcgctgcagacgataacgattatccggatgcatacgcagagttcggtgatgtgacatttgtatccgacgagtccgcattagagggcgaggaagatttactcaatgcattgaacgctgattccggattgaacatcaatgcaggcggaaaagagaaggttcaggagatcattgagcatgcttctaacggtgatatgtcctacgatgacatcatggctgagtggaatgagaagtggacacaggcacaggaagacaatggcgtgacggcagaataaataagacatcatgcacagacgggaccggaatgagagatctgtttccggtcccgttattttaaaaacagggtgaaaaagatggaggttggatatggcggcgacatcagtaaagaaagtagaaaataaaacagccaggcgtggattcctgaagtgggcaaaaagcaggaaggggcagcagacactgattatactggcatttaccataattccgcttgtgctgttggcagcatttacctatgtgccatttgctgaaatggtgaagttcagtttttacaaaatgaaatattccacgccggtagataaacgggtatttgtgggttggaagaattatatcgaggtattccgcaacaaggatatttttgcatccctgtggttaagcctctactacatggtaggttcggtggtacagcttgcgcttgcgctgttccttgcaacgattttgagctttaagacaaggggaggcaatctctttaagggactgatgtttttcccgtatctgatcagcggtattgcgatcggatttatctttaaatatttttacacaagaggatttgtattcgattccatcctcggatggtttggatttgaactggatagtcttccgtactggctgcgcgatcagaagatcaacaactggtcactggttgcaacttctgtctggagatatttcggcaacaacatggtgctttttatcggagcgattatgtctgtagattccgagatgtacgaggcggcggagctggacggtgcaaataaatttcagcagtttgtacatatcatactgccgagcatcaagacgattgtgacgctgaatgtgattttatccatcacaggagcactgagcgcattcgagcagccgttcgtaattaccggaggttccaacggaacggcaacgtattttatcaacatgaacaatattgcacataccagccagaaggtcggactcgcgtcggcgatggcggttgtgttacttcttatcattttcgcatgtacgatcttacagaaactgttctttaaatatgtataccgcaatgcggatcaggacgatgaagtcatgaccagggaagagagaaagcggttgaaacagtttcacaaagaacagagagcggcgaaaaaagcagcaaagggggcgatgtaaatgaaaaagcgcagaaaacagtattcggcaggagccattatctggatcatttttaaatatgtatcgcttgtgtttttttcctttgtcgccgtgattcccattatttcctgcgtcatcactgcattcaagacggaggaagagtataagacgacgaatgttatgacactgccgcagaactggttcaattttgacaactttgtggaagcgttccagcgtgcgaacatgggaagggcattcgtgaattccgtgatcgttatggtctgtgtcctgatcggagccatcatcatcggtacacagcttgcgtatgtgttaaaccgtttccagttcccgggcaacgggctgatccgcaacctgtttttattcgcggcactgcttccgggtgttgccatgcaggtaacggtctaccagatcatgcatgatcttggctttatcaatcatctgtacggctacatcatcatgatgatgggaacggatgtcatctccatctacatctttatccagtacatggaaaatattccggtgtcgctggatgagtcggcaatcatcgacggagcgtcctactggaagatctactggaagatcatgcttccgctgctaaagccggcaattgtgaccgcctgcatcttaaagggcgtgggcgtgtacaacgaatactattcggcaaacctgtatctgaccaaggaaaacttaaagacgatggcgatctccctctatacctttaccggaccgcttggaagccagtacaacctgatctgtgcaggtgttatcatttccctgctgccggcactcatcgtgtttatcgtattccagaagcagatctacagcggcattacggcaggcgcagtcaagggctgattacaggaaaagaggaacagcgatggaaacattagaaagcatgcgaggagaagttaaaacggaacttctcacacatatcattcccttctggcgtgcactgcgtgacgacacttacggcggctattacggctggctgtcttatgatcttgcactggatcagaaagcggaaaaaggatgcattttaaacagccgcatcacatggtttttctccaatgcctacacggcatatcgaaagggactttttacggaggaagactgtagaagcgcaggctataccggagaggcgctcttggaggaagcaaaacacggctacgtctttttgaaagagcactgcatcgaccgggagtacggcggcatctactggtcattaaactatgacgggacaccgcttgatacgacaaagcacacctacaaccaggcgttttgcatctatgcattgtcctcctactatgaggcgtcgcacgacgaggaagcgcttgcactggcgaagcagctcttttccctgatcgaagagaagtgtacggatgaggtcggatacctggaggcttttaccagagagttccagccggaatccaacgagaagctgtcggagaacggcgtgcttgcagataagacgatgaacaccctgcttcatgtttttgaggcgtacacggagctgtaccgtgtgtcgcgggatgagaccgtgggggagcgcctccgttggatcatggatgtgtttgcagagaaagtatacaatccggcgaagcggagacaggaagtatttttcgatgccgggtatcacacgattttagatctgcattcctacgggcatgacattgagacagcgtggcttttggaccgcggcgtcaaggtgctgggcgatgaggcgtatgaggcgaaaattgttccgatcacacaggcgcttgcggcacatatttatgagacggcgtttgacggacactccctggcaaatgagtgtgacaggggcgtagtcaatacacaccgtgtatggtgggtgcaggcggagacagtagtcggatttttaaatgcctgtgaacagatgccggatcattcggagtaccgggatgcggcgttggcggagtggcagttcatcaaagaacatgtcattgatcctcgcaggggaagcgagtggtactgggaagtgtatgaggacggaagcccgattttagaccggccgatcgtggaaccgtggaaatgtccgtatcacaacgggcgcatgtgtatagaggtactgggacgcatcaaggaaaattgaggagaattggttatgctgcataagagatattatatagaaaaagaaaagcaggaaaaactgcttgcacggaaaaacgagaagtcggatttttacaacggcgtatttgaccgttacgagtatccggttctcacgagagaacatattccgctgacctggcggtatgatttaaaccctgacaccaatccgcactttatggagcgtctcggcatcaacgccgtgatgaactccggagcgatcgagctgaacggaaaatattatctggtggcgcgcatcgagggaaatgacagaaagtctttcttcggcgtggcggagagcgacaacggaatcgacggtttccgtttctgggattacccgattcttctgccggatacctgcccggaggagacgaatgtctacgatatgcgcttgacgaagcatgaggacggttatatctacggcgtgttctgctccgagtcaaaggatacgagtgtgagcgatctctcagcggcagtggcggcagccggaatcgtccgcacgaaggatttaaagacctgggagcgcctgccgaacctcatcacgctgcgttccccgcagcagagaaacgtggtgctgcatccggaattcgtcgacggcaaatatgcgttttacacgagaccgatggatgattttatcgagacgggaagcggcggaggcatcggattcggtctctgcgaggacatcacacacgctgtgatcgatgaggaaaaaatgacgagtctgcgcaagtatcatacgatcacggaggcgaagaacggagccggtgcgacgccgatcaagacggaaaagggatggattcatatcgctcacggtgtgcgcaacacggcagcgggactgcgttatgtcatctatgcgtttgcaacggacttaaaagatccgtcgaaggtgattgccgagccgtccgggcttctgatcggaccgagaggtgaggagcgcgtcggggatgtcagcaatgtggtatttaccaacggagcggtcgtcaatgagaaaaacgaggtgtttatttactacgcatcctcggatacacggatgcatgtggcgaccacgacggtggagaagctggtggactacgtattccatacgccgtccgatccgggaagatcggtggagtgtgtggcacagcggtgcggtctcatcgagaagaatcttgcatttttaaaagcgaatgaataaatacggtcatcatagaaaaatgagccgcgtcggcggcagaaagaggtagaagttatgagcaaatataaaatgatcagccccaaagtaccgaatgtgccatggcaggagcgcccggcggagttaaacggagcaccggtatggagatacaaggagaacccgatcatcggcagaaatccggtgaagggcgtggcgagaatcttcaacagtgcggtgatgccgtacggggatgagttcatcggcgtcttccgcggagaacagacgaacggaattccgtatatctatctgggaagaagcaaggatgccatccactggaattttgaggaaaacaagattaactttgtggacgagaacggtgagtccttcatgccggtctacgcttatgatccgagacttgtgaaggtggaggatacctactatattatctggtgtcaggatttctacggcgcagcgatcggtatggcgaagacaacggattttaagacatttaccagaatcgagaatccgttcctgccgtttaaccggaatgcggtgctgttcccgcgcaagatcggcggcaatttcatgctgctctcgagaccgtccgacagcggccacacaccgttcggcgatatttttatcagtgagagtccggatctcacctactggggaaaacaccgtcatgtgatgggcaagggttccgagtggtgggagtccttaaagatcggcggcggtgcagctccgatcgagacatccgagggatggcttctgttctaccacggtgtgagcggcacctgcaacggatatgtgtactcgatcggcggtgcgatcttagacatcgacaatccttccatcgtgaagtaccgctgtgagacgtttcttctgactccggaagagtggtatgaggagcgcggattcgtgccgaacgtatgcttcccgtgtgcaacaatccacgattcggagagcggaaagattgcaatctattacggagcggcagacagctatgtgggactggcgttcacggaactggatgacatcatcgattacatcaaggaacacagtgtggtgacgacaaccgataccgagatcggaaaaagataacagagaactggaatgatggggctgcggcagccggaaagagaaggacgcattgtgtgcgtaacacctcggggctttcgcagccctgctgcgtatccggcggggagccggaaggcagagggggaaaagaaatgacagcaaaaaaaatggtcaggaatatcgagccggacgatccgatgttacagtacagcggaagaatcgatgacgacgatccgaaggcgccggtgcttatctatgcggcaagctgggtgaaaatgatttttaccggaacatcggtggcagtcacgcttgccaaccatcatgcgtactggacaaatgagatgggctatctcttagacggggtgcaggggcgcatccgccttttgaatgacggaaaaaagaaaacctatgagattgcggggcagctgccggatgcgcggcatgaactcatgctgttcaagcgtatggacgcctgccatacggtgacattctacggatttaccgtggatggcggcgcagatcttctgccgccggagccaaagcccgcccgccggatggaagtgtttggcgacagtgtctcgtgcggcgaggtgtcggaggcggtcgactatgtcggaaaagaggatccggtgcacgacggacagtattccaacagctggtattcctatgcctggatgacggcgcgaaagcttggggcagaacttcacgatacctcacagggcggcattgcgctgcttgacgggacgggatggttcggcgcaccggcgtactacggtgtggagtcctgttacgacaagctcgcatacaatcctgatctcggagaggtaaagaaatgggatttttcacgctatacgccgcaggtggtggtggttgccatcgggcagaatgacaatcatccggtggactatatggcgtcggatccggagtgcagtgcggcggagcactggcggaagcgctaccgggaattcatcgagacactgatgaagcgctatcccaaggcgcagatcattcttacgacaactatcttaaaacatcatccgaactgggatgcgtcgattgggacggtgtgtgggcagatcgcaagtgagcgcgtgcaccactttttataccggagaaacggctctggaacgcccggacacatccggattccggaagcggaggagatgtcagaggagctggcttcctatatccgttcactcggagataaaatctgggatgtgtgagagacaataaagggaaaagaaagagagaaggagcagaaacatgaatatgcagattgatctggaaaagggaattgcaaatgtgggagatgtgagcagaatgaaggaggtcatggcgcgcgccagacgcggagagcagctggtaatcggttttatcggcggctcgatcacgcagggaagcctctcctcgacaccgcagacgtgctatgcctaccgtgtgtatacatggtggaaagagacctttccgcaggcggagtttgtctactgcaatgctgggatcggcggcacgacatcggagttcggcgcggcgcgtgtggggacggatcttctggcggagagaccggactttgtaattgtggaattttccgtcaatgatgagagcacggagcattttaaggagacctatgaaggactggtgcggaaaatccttggtgctgcgtggaatccggcggttcttctggtacacaacgtgttttaccacaatggagccaacgcgcaggtgatgcacgcggcaatcggcagacattatgatctgccgtcggtcagcatgcagagctctatttacccggaggtggtggcaggacggattgaaaaccgcgcgatcacgccggatgatctgcacccgaacgatgagggacatgcgctggtggcgtcggtgattacttattttctggagcaggtacgaagcggaaaactgaccggcagcaatgccagttttgcaccgggggcaaagcttccggttccgcttacaaaaaatgcctacgaggattctgtccgcatccgcaatgccgcggcgccggatatggcaggattgcagcagcccacgctggatggatttacgcccgatgagaccgcacagaatggaatcacggactgcttccgctatggctggacggcggaaaagacgggggatgccatcacctttttggtggagggcagctgcattgccgtccagtaccggaaatcggtaaagcttccggcgccggctgcactggcggtcgtggacggcgatgaggagcatgcggtgcggctggatgcaaacttcgatgagagctggggagacaaactggaacttacgacgcttttagaacacggaaaagaggggcggcacaccgtcacgatccgcctcgcagagacgcatgaggacgatgcggttccgttttatctggtgtccgtgatcgcagcggggagaagaggaagagactgacggcaagagacagcctattttgcagaatgtgcgtgtaaaaggattgcaaaatcagaaaaaatgttggaagataaagagagacactgcgattgcaggagcaggaggttataagaatgtttcgagaggattttgtgtggggtgttgcgagcagcgcctatcaggtagagggaacggatgcggcggacggcagaggcgcgtgcgtctgggatatgtttgcggcggacggcagagtgtttgaacatcagaatgcaggcacaagctgcgatcatatgcatcattataaagaagatattgcgctgatgaagcatctggggatccgggcgtaccgtttttcactgaactgggcgcggattctgccggagggaaccgggcgcgtgaatgagaaagcgatcgccatgtaccgcgatatgattctcacgatgaaggaaaacggcatcacgccgtacctgacgctgtttcactgggaattcccgcaggcgctttatgagcggggcggctggcagaacccggacgtggtgcaatggttcggagaatatgcgaaggtggttgccgagaatttcagcgacatctgcgaatattttattacgatcaacgaaccgcagtgcgtggtcggtcttggacatctgagcggtgttcatgctccgggcgtgaagcttcccgtggcgcagacgtttctggtggcgcatcatcttctgatggcgcacgggcaggcggtcatcaacctgcgcagatatgcggtccgaccggtcaagatcggtttcgctccgaccggcggcgtggcgtatccgtacaccgaccggccggaggacattgaggcggcgaaaaaggtgtatttcggattttacaatccgatcgataactggacctggaatgtatcgtggttttccgatccggtattccttggacattaccccgaggaggggctgaaaaaatttgcgccgtatcttccggagatcacacaggaggatatggagctgatctatcagccgcttgattttatgggacagaatatatataatgggtactacgtccgcgccggcgcagacggcgagccggaatttgtagaccgtgcgccggggttcccgaagacgggatcggactggccggtgacgccggaggcgttttattacggcattaagtttttgacggagcgctatccgctgccgctctacattacggagaacggcatgtcctgccatgatctggtgagcagtgacggcagggtacatgacccgaaccgcattactttcctggattcctatatcggggcaatgcagaaggcatacgatgagggcgccaatgtagccggctatttcctctggacattcctggataattttgagtgggcggacggatataagcagcggttcggcattgtttatgtggattttgcaagccagaggcggattgtgaaggattccgctttctggtatcagaaaataatcgagacgaatggaaggatgttgacaatgaatcagacaacaaaagaaatcttatttttagatccggtgtgcacacacaatatctggggcggcacccggcttagaacggagttcggctatccggtggagggggatgacatcggcgagtgctggggcatctccgcacatccgaacggcgacggcagcatcaggaacggtgtgtacgccggcatgaaactgtcaaaagtgtgggaggagcacccggaggtatttggaaacctcgcctacgaccgcttcccacttttgacaaagatcatcgatgcgaaggcggatttgagcattcaggtacatccggatgacgcctatgcaaaggaacatgaaaacggttctttcggcaagacggagtgctggtacattatggatgcgcccgagaacgccacgctcgtgatcggtcacaatgcgaagacgaaggaggagcttgcctccatgatccacgagggacgctggagcgaatttatccgcgagattccggtgaaaaagggagattttatccagattgatccgggaaccgtccacgccatcaagggcgggcttctgatcctggagacacagcagaacagcgatattacctaccgtgtgtacgattatgacagactgcagaacggcaagccgagagagcttcacattgagaagagtatcgacgtgatcaccgttccggcgaaatccgtcgaggacagtgtaacgtctgcactcggactgccggagaaccggctgaacgagctgtacgcctgcggatactatcagatttacaagctggatgtcaacggaacatgcagttttgcacagaatcatccgttcctgctgatgtctgtgctggaaggtagcggtatcgtcaacggccagccggtgaaaaagggagatcactttattttaccgtgcggattcggcgaggtggagatgcagggagagatgagtctggtggtatccacggtgccggcgcaggcttaaggggaaaatagctctttcggttccggaaaagatttgctataatcagaccatagaaaaagagaacacctggaaagaggaagcatatgaatcaggaagagagacgtcagagaagacagaaagatacgaaaagtgcggtcattgtgtgtgtgatagtcgtgctgatcctgctcgtgttagtcgcgggcggagtatttcttgtgggacgcctgctgccaaagggaggcggacagaatgaaggtaccgacggaaccgagctgccgggagagaatgtcgcggcgacggaggaagtaacggaacagccgcagacggaagtacagaccgatccggtggaggagcaggcggcgcagcttgtgtcccagatgacgcttgaggataagatcgcgcagatgtttgtgattacgccgaatgcgctgaccggatatgcaagcggtgtgacggctgcgggggacaccacaaaggaagcttatcagagccgtccggtgggcggaattgtgtatatggcagacaacctcaccgacccggagcagacgaccaccatgctctccaatatgcaggagattgcaagggagcgcaccggacttccggtatttttatgtgtggatgaagaaggcggcagtgtcgcgcgcatcgccggcaatgatgccttcggggtgacggacgtcggcaatatgagcgatataggagcgagcggggatgtgcagaatgcatacaatgcgggaagcacgatcggcagctatcttgcggcactcggattcaatgtggatttcgcgccggtggcggatgtccttaccaacccggacaatcaggtgatcggacagcgctcgttcgggtcggacgcgcagacggtcgcgggaatggtgacgtctgaactgcagggactttccgcggcgggagtgtacggtatggtcaagcatttcccgggacacggcggcacttccggagattctcatgacggggcggtgtccacggacaagaccctggaggaactgatggcggaagaactcgtcccgttccagagtgcgattgacggcggcgtgaattttgtgatggtcggacatatctcggctccgaatgtgactggagacaatgcgccggctacgctgtcgaaggtgctgattaccgatgtgcttcgcggacagatgggatataacggaattgtcattacggacgccatgaatatggaagcgatcaccggattctacaattcggacaaggcggcggttctggcagttacagccggggcagacatgattttgatgccggcggactacaataccgcctatacaggaattctgaatgcggtgaatgacggaacgatcaccgaggagcggatcaatgaatccgtgacgcgtatcgtgaaggcaaagcttgccatggggcagccgtaaaagctgtttgtattttgcggtaattatggtacaatgaaggcaagtgttatacattaccatacgaaagcggagggatttgcgtggaagatacgaagaaaaatgagatgtgggggaaagtgatggcaccgcttgccggctttcttgccattgtgctggtggcgtttctgatcattttaaaattattggaaagcggagtgatcggaacagtcatggcgatgattctgatctgcgtgatcgtggctgccgtgttcggcggaatcttcatggtgatcaagtcgattctggatcagatccggtccgtgattaacggaaaggtatcggagaatacaaaagttgcggaaaaggcaaaaaagcttgccgaccgtgaagacggcatcggggagatggtgcgttccatcgagacgtccgtttcatcgattgagctggtgcttggaggaatccgcaaggctgtggatgagctcgaaggggtatccggtgatttccagcagattttctcggaaatgtcggagtcgatggatcagacggcagatgctgtcgatacgatcaccggcaatacggtgtcccaggcgtctgagacggcggatatgaaggaaaaggtggacgcgatcagcgtgtcgatcgatcatatttcttccaatattgaggatctgacgaagagtgcgcaggccatgcgtgaatataaccgttcggcggagcagattatgcaggagctgattgccatcagtgaggagagcggcgttgcgatcgagaatgtcagaaagcagacagatctgacgaatcagtccgcgcagcagatccggacggcgactgagatcattgcgggaatttcaagccagaccaaccttctggcccttaatgcgagcatcgaggctgccagagcaggggagcacggtaagggattcgctgtggtcgcggaggagatccggacactggcggatcagtccagagagtccacagagcagattaaccatgtcgtgaatgtcctgctggataattcaagcaacagcgttcagattaccgagcaggtatcggaggcattttccagacagaatgagaagattcatgacacggaggagatcttcaaatcattgaaccgagaaatcgaacaggtcggagatgctatcggcggaatcggcacggaggtcggcgatcttgagaatcacaagagcgtcattgagaacggggtcacttcccttacggcttcggcagatgagaatgcgaagagcgcagaggtcaccacagataatatgggacgtctccgcggcgtggtgaaggagtgcgatggcgtaaaagcgcacatcgtcagcgtatcggacgagctgattggatacatccgtaagttttcggacggttcgattctcgacaagttcggtgcgggtaaaaacagataaacatttagcaggaacacaggaagtattgttacagagagccgtattgcggctctctgtaagtggttataggggagaaggtacagatgaatcatacaacggactggggcagaagatggcgcaacaccggctatattacattctttttgagcggtatctgcgcaatatcgagcgggattattgtaagtattctgcagggaaaatatgaatttgactatggcatgacgggtacgatgctcggactgatgagcattggaaatatggcggcgtcctttgcggcgggtattctgccgcagaaaatcggagtgaagaatacagtgcttcttctctgcagcggttatttcctagggtactttctgatggcggtgactggaatgccggccgtgttgatggcggcatttctgttggtcggatttgcaaagggaggggcactcaataattgcacaatccttgtaaaagacaatagtgccgatcgcacacgcggcatgaacatactacatgcctgctatgcgagtggtgcgctgctgtgtccgtttcttgcggcgtcgcttcttgaaatcaacgacactctgccgatggtgggagtggcggtgacggggctgcttttgtggatgatatttttgacggcgggacttccgggcgcggtcaaagagaagaacggcgaacggggaaagatctcgtttgcatttttgaaggatccgaaattctggctgattaccggacttttattctgccagaatgcggcggagacgagtgtgacgggatggctcgtgacatactataaagacatgggaatcctctcgggttcctttgcggcatacacggtaacggtgatgtggggggcgactctgatcgccagacttctgatcgcgttcgtttttccggtgcatcatatttttcgcacgcttgcgtggatgggcggctgctgcagcgtgctgtactgcgggcttgtatacatgcagcatccgacgggagccatcgccatgctgttcgcctttgcattcgccatggcaggggtcaatccgatcgccgtggcgggagccggcagggagatgaatgcaacgagtctcggtgtgatgctgccggtggcagggattggcgcgatcgtgatgccgtggctgatcggtgtgattgctgatcgtgtggggcttgtgaccggaatgttctgcaatctgattccgtgcgtgggcattctggttttttccgtattgatcctgaaatatcaggcaaagaattgaacttgtttttcaaaataaaggtagaatgctaaatattgtgccatttttgccaaaaactatctaaagaaaaaagtgcggttctgtgttacgatgcagacagatgaatgttgacgatactttttatggagggatgcgacacatgagagaagtaatcaattttaatacgaaatgggcatttaccaaggaagccacagaagtgccgaaggagatgccagagaagtggtactgggtaacacttccacattcctggaatgagattgacggacaggacggcggcaacgattattaccgcggaacctgttattatgcaaaacagttaaagaagagcgaactgccggaggcagactgctattatctggagttaagaggagcaaacgcttccgcagacgtctatgtgaacggcaaggcagtggtacatcacgacggaggatattccacctggcgtgtagacatcacaaaagagctcacagaagaagagaacctgattgtgatcgctgtggagaatggcgtaaacgacagagtatatccgcagaatgcagatttcacattctacggcggactttaccgtgacgtcaatatcattgcggtaaataagtcccattttgatctggactactacggcggacctggcattaaggtgacaccggagatcaagggcgcggatgccagcgtggaggtagaggtattcctgacgaatgcagctgcagaccagaagcttgtatataccgtaaaagatgcagagggcaaagaggttgcaaagacagagaccgcagccggcgagacaaaggctgtactttccattccggcagttcatctgtggaacggaaagaaagatccgtatctgtacaccgcagaggtggctcttgtatccggagaggagaccgttgatgcggtaagcacacgtttcggatgccgtacctttgagattgatccggagagaggatttatcttaaacggagaggaatatccgctgcgcggtgtatcccgtcatcaggacagatggggaatcggtaatgcgctgcttccggagcatcacagagaggatattgacttaatctgcgagctcggtgctacaacgatccgcctggctcactaccagcacgatcagtatttttacgatctgtgcgatgagagaggtcttgtaatctgggctgagattccgtacatttcctctcacatgccgaacggacgtgagaataccatttcccagatgaaagagctggttgttcagaattacaatcacccgagtatcgtggtttgggggctttccaacgagatcacgatggcaggaagctcggatgaggatctgcttgagaaccacagaatcttaaatgacatggttcatgagatggatcacacgagactgaccacgatcgcggtggtatccatgtgtgatattcacgatccgtacatccagattccggatgtgatctcttacaaccattacttcggatggtacggcggagacgtatccatgaacggaccgtggatggacaacttccacaaagagttcccgaatatcccgcttggaatgagcgagtacggatgcgaggcgctgaactggcatacctctgatccgaagcagggcgattacaccgaggagtatcaggcatactatcatgaggagatgatcaagcagctcttcaccagaaagtatatctgggcaacgcatgtatggaacatgttcgatttcggtgcagatgcgagaaacgagggcggtgagaacggtcagaaccacaagggactggtaactttcgaccgcaagtacaagaaagattccttctatgcatacaaggcatggctgtctgatgagccgttcgtacatctgtgcggaaaacgctatgtagaccgcgtggaagataccacgaaggtaactgtatactccaatctgccggaggtagagctgtttgtcaacggcaagagtgcaggaaagcttcaggcggaggatcatttcttccactttgaggtaccgaatgtcggagaatccacactggtggctgttgccggagcgtataaggatgagagccacatccgcaaggtggataccttcaacgaggagtacagcctgaaagagagcggcgcaatcctcaactggttcgacatcacagagccggaaggatattattcactgaatgacagactttctgatatcatgaagtccgaagagggaaaagcactcttcatgggactgatgtcaaaagttgcagcgggaatgagtcagggtaatgaaaaaaatgacggaaatcctgcagcaggagcaatggcgaacccgaagatgctggaaatgctgggcggatttacggtcatccgtatgatcaacctgatgggtgcggcaggaccgaaggttgagtggaagaaagaagatcttctcggactcaacgcacagctcaataagattaagagagtagactaagatagaagcttaaaagaccggggcatggaatgtggtgggcagagatttaaaaaaatctgtacctgcacggttccggactgccaaccggcggcgggaatcctttgaagcaaattgggagcatttcttctatgccgcgtttggtatcggattccgtgtctttccacgttttgacaatccgcgaaagatgtccgacaaccgcagacaatgggcggactttttagcagcgctagcaacgcttcttcacagacaatataaaaccgcgcgaaccgaaactcgttggcatctgctattgaaaataaggcagatgccaattcaaacatcggcttcgcgcggttatgttttattcagaagcgcagacaagcgctgcacaaaagtcctaaaattgtctgcggattgcggacactctccgcggagtgttcaaagcttggaaaaacacggatcatcggagataccaaacgcggtatagattagaaataccccattttgcgtttcggattcccgccgccggttggcagtccggaacaggcagatacagtatatttgcaaaatccatgcctgccacattccatgcccggtcttttagcgtctccactcgcgtggtgtcatgcccgtgatgcggcggaagagccgtgtgaaatagtggacgtcggggatgccgcaggctgccgcaacatcctgcaccggcaggagggtactgcgtagcagcttcttggcgtattcgatacggtttgcgttgacgtagtccgtcagggtcatgccgacttcctttttgaacagcgtggacaggtagcttgtattcaaaaacagttcgctggcaaaacgtttcaggcttaagtccccggccagtgaggcgtctatggtgacgagaatctggcggatcggatcggaatacgaactcatgcttcgctgttccacgagctgacagtaactttgaaccatgtaggatatgagatcgttgatttcttccacggattggatgctctcaatcatgcgcgcaaagttgccggagacggcgtcgatataaaacgggtggacgcccgtttcgtacgcttttctccgcaacagcgtgttgagggtcagaatcaggttcttgcggttgcggagtgcgtcctccgtgcgggggacaaagcgcaggtttccgagagcctccatgaaggagagggcacgggcgctgttgccgtgagagatggcgtcgagcagctcatcctcgatatggtagcgctcttcaagaaggtgcatgcttaagaccgggtcctccggtacgacaaactggtgcttttccaaaaaggactctctggtctcgagatctttcaaatgcagggtctgtacggatacatccgcgtcggcatccagcgtctgatagacgtggcgcagcagggcggtcatggaggctttgtccgcgatcagcggcagggcgtgataatattcctgcagctgtggaaaaagttcagccggaatatccagccggtttataagcgacagaatctgggagcgctcaaattctttccagagaaaaggcccgacgaacaggaaggcacttttatccggcagacggaaaaaagaataattacactcgtaataatctacaataaaatagatggtgttctgcacaaatggaaatggcgcctgtttttgcgcatcggcttcctgcatcaggatactgttgcgcagtccgagatccagatccgccagttctaactgtttgcggtcggtcagtctgcactggatatgcaggtcagaaaaatatgcggtaagaaaagataaaatcggctgctccatcaagaacctcctgtccgggtcagtgtctgttgttttgattttggcacaatattttctgttatgcaaggaaaaacaaaaaaatgacaaggattattcatccctttaaagcatcggcttgcagaccggagcaatttatgataattctataacaacgtgttcacggtgaacacattttagaaaatagtgcagaatgcttgaaagagaggatacccatgaaaatcacagcttatgaagtgagaccggatgaaaaagattacctgcttgccgcagcacagcaggagcagatagagattacactggtgcaggggccgatgacacaggacaacattgatcgtgccgagggagcggacggcattacgattcttggagatacaaagatggacgccgcattgattgaggagactgcaaagcggcgtatccgcgtcgttgcgacacgtaccatcgggtatgaccatattgacatgaatgcggcgaagagcaatggcgttcacgtctgcaacggctactacgatccggacggcgttgccgagtatacggtcatgctgattttaatgtcgcttcgcaattataagcaggcactgttccgcgggaatgccaacgattattcgcttggcgggctgatcggaagggagcttcgtaatcttaccgtcggtatcatcggaacgggaaaaatcggacagaaggtggcacagaatctgcaggggttcggctgcaggattctggcatacagcagacgtcagaatgccgatccggcgcttggaatcgaatactgttctctggaggaactgtacgcgaagagtgatattatctcactgcacacgccactgtccaatcagacacgttatatgattgataaaaaggcgatcgaccagatgaaggacggcgtcattctgatcaactgcgcgagaggagagttgatgcgcgtggatgacatcatcgagggaatcgagacgcggaagatcggtgcgctgggactggatgtgatcgagcatgaggagggaatctaccatatggatcgccggtcggatattcttgcaaaccggaatatggcgtatctgagacagttcccgaatgtgacgatgacgcagcacattgcgttttatacagaggaagcggtaaaaagcatggcggagagcggtattgtcaatgtggtgaaatgcctgaaaaaacaggataatcctaacctgatctgctaagttcatatacaaaaagagtctgccacaagaaaacttgtgacagactctttttaaatccattgtttgcaatatcttaatctaacaaataaaacaagtctattttaagaaaaaggtacatgaaactagtgatttaacgcggtaagcttaccgcctgcagtaattattttactacagttacgttggttgcctgcggtcccttggatccttctacaacgtcgaactctacggaagcgccctcttcaagagacttgaaaccttccatgttaagtcctgagtaatgtacgaatacatcgttgcctgactcgtcagaaatgaatccgtaacccttctggttgttgaaccattttactgtacctttcatcaaaaagtacctccaaaaataatactaactgtaacttacagctattagtacaatatcataagaatttataaaagtaaagtaataaattaaagttcttcaaaactaatttcatgcgcagtgagaaagcgctttacaagggaatcccactcctgatcgaggctcttgtccacggagaaaatccggtacgaaatgcccgtggtaaggagcagttttttctgctggaatttcagattgataaacattcccgtaatgtcctccggggtaaaagaactgtgggtcgaaagcagtgtccgttccagattcttcggggagagcagaaagacaaatttaaaataagaaggagtgcgtctgcccttgatcaggtcaaaacattgcggacgtacctgttcaaacgggagaaaagaaagtcccgtcagtccgagcgcatcggcttcatctgatgaataaaaatcgggctggatcgtgccgtctaagctccaggtgacgctgcccaagatgacggcttcctttagaagaaagtgcccgaacgtgtccgtacacagcagtttattcataaaatctttaatttccggtagggaaagtgcaatcatagtcttctccgtgtcatatagtattggggcgcattgcctttgtgtagtataacacagattggggacaaatagaaagccgattgggaaggtttgcttcacaatatgatttctggtatgataggaagctgagagaacagccccggaaggggtcacagataaagaagaaaagaggacatagacatgaaagagacagaacttttatttgatttgctgaaaaaaggtgtgtcgccggtacaggcagtccgcgcctgcaaagagcgcctggagagcgcgggatttctggaactgccctatgatgagccgtggaagctgcagaaaaacggaagatattatgtaaatcatcatgacaccacactgttcgcgtttacggtggggggcggctggcaggagacaaagacgccgcagattcggatggcggcagcacatacggattttccgtgcctgcgcatcaagccgtcggcggatgtgacggcttgcggttacgcgcaggtgaatgtggaagtatacgggggcgcgatcttaaatacctggctggatcgtccgctcggtattgccggccgtgtggcagtgcgcacacaggacgcgtttgccccgaagattgtggagtttgtatcggaaaaaaatcttctgaccattccgaatctggcgatccacatgaaccgcgaggtcaacaagggtgtggagctgaaccgccagacggatatgctgccggtctttgcgctgctgccggaggaggagaaaaaagcggactacttccttacattcctggcagacgagctgtctgtggagaagactgacattctggattttgaactgaccgtatactgtaaggaaaatccggaattcatcggtctcaacgatgattttatctcaagtccgcgcctggataacctgacttcctgcgcggcgctcatctccggtctgattgatgccaggcggatggagggaatcaacctgatcgcactgtttgaccacgaggagatcggaagccgcacgaagcagggcgccggctcgattctgctgcatgacatgctgcgccgcatcttaaaagagctgggacgggaacagacggcggagcaggatctctatcgcagcatgctgctgtccgtggatgtggcgcacggcatccatccgaaccaggcaggaaaaatggatcttaccaacaagcccgtgctcggaaggggattctgtatcaaggaggcgagttcgcagtcctatgcgacagactgcgaggcgattgccatcatccagcagatctgtgagaaagagaagatcgcgtaccagaagtttgtgaaccgctcggatatgccggggggaagtacgcttggatcgatcgcttctgcgcttcttccggtgaagaccgtggatatcggaatcccgcttcttgccatgcattccgcgcgggagctgatgggcagcgctgaccagcaggcgttaaaggatcttgtgaccgcatattttacactcgcttcgtgagaaagaatgcttcgtaagatataatttagataaagtttagaaattacctctatacaaaaaatggtttttgtgttaatgtaacatagtattgaatactacatgcgatagaaacgaaaaatatattaacggtttattgataacattaaacacataccatagaacaggtggagggattgccatgtataagattgttgtggacagctgcggggaattaccggaggaactgaagaaggacggacattttgagacagtgtccttagaacttgaggtggacggttaccgcattaaggatgatgagacatttaaccagcttgattttctgcgccgggtgaagaagagcatcacgggaccgaagtccgcctgcccgtcaccggagcagtatatgcaggcgtatgagggagaagcggagcatgtatatgtggtgacgctctccgggaagctgagcggttcctacaacagtgcagaactcggcaggaacctctacgaggaggaacatccgggagagaacaagcagatctatgtatttaactccaggtctgcatcgatcggggagacgattattggtcttaaggtgcaggagttcgaggaggcaggtcttccgtttgaggaggtcgttgccagaacggaggagtacatcagctccatgaatacttattttgtcttagagacgttagagactctgcgcaagaacggaagactgaccaatctgaaagccctgattgccaatacgctcaacatcaagccggtaatgggttccacaaaggagggcatgatctgccagctcggtcaggcgcgcggaatgaacaaggcacttgagaaaatggtgcaggatatgatcgggcgcacgagggactgcgaacagcgtgtgcttgccatcgcgcactgcaactgcccggagcgcgccgcagcggtaaaagcccgcatagaaaagcttgcaaatttcaagaaaatcattatcataaatactgccggtgtcagcagtatgtatgcaaatgatggcggcgtaatcatggcagtgtaagacacgcgggtgtgtcgctgctgcccggagaggaacgcgggacacagatgacatatgaagaagtagtagatcagatcaatcagatcagaagattcgggaatcttgccggagtggaggttgccgggcgcatgttaaaggcgcttggcagtccgcaggcggggattccgttgatacacatagcagggacgaacggaaaaggttctgtctctgcttttctctgcgcaattttaagggaggcgggacttcgcgtcgggatgtttacctccccgcaccttgtggactttcgggaacgcatccagataaacggggaaatgatctctaaggaggatacgcagaggatcggcgtgcagcttcttgcgatggattttggcgtacagccgacgatgtttgacgttacacttgccatggcaatcctctattttaaggaacaacgatgcgatgtcatgatcttagagaccggacttggcgggaggctggacgcaaccaatgccgtaggtgtgccggatgtaaccgtgatcacaaagatcggctatgaccacatggcggtgcttggaaatacgcttgctgagattgctgcggaaaagacgggcatcatcaaaaaaggcacctcgcttgtgcttgagaaccaggaggcagaagtcatgacggtgtttgaggcgaaggtcagggaggaaggaattacagatttccggctgatcgaccctttggagataaaagagcagacttaccgcgacggcagacagtatttttcgtttggtgcctaccgtgatctgtccatgcgcatgcttggcgttcatcagtatgagaatgctgtcgcggcgcttctcggggcggaggcatttttcaggagacatacagagtggatctgcggcgggacaaaagagcgggaagagggcgtaaggcgcgcagtctgtcaggggatcgctaagaccgtatggaagggcaggatggaaatcctctcaaaaaaaccgttcctgttggtggacggcgcacacaacagcaacggcgtggaagcgttaagagagagcctcgtggcgcttttcccgggagaaaagtttcattttatcatgggcgtgatggcggataaggattatgagacaatgatcggggaattgctgccgcttgccattgattttacgacctgcacggtggagtgcgagcgggcgctgcaggcggacgccctggcggattgcatccggcggaaaggaattgcagctgcatcagctgatgattttgcgtcctgttttcagagagggcggctcgatgaaacacatcgcacggttgcgtttggttcgctctatttcatcggtgagatcgaggcgctgtttgaggcaaaatagttacgaaaagattacagaatagagcgtttatgacaaaaatgatacaatttcacaaactttcagtaatagttcaccattttgtaatatttcgcctataatgaggtatagtaaatagggatacagtagatagaagtcagatagaaagagtctgtggaatgttatttagcagttttgagtttttatttcggtttttgccggtttttttagtgatatattatcttacaccgaaaaagttacgcaatgtcacattgctggggggaagtattgtcttttatacaattggcgaggcgggttatattacgattctccttgcgtgcgttctggtcaattacacgctgacccgtttgatgtaccggaagaatacggacgggcggggaatcaggcagaaacgcttattgcttcttgcgctcgggtatgatctgggcgtgctgtttttcttcaagtacagtggtctggcatccggacttccgcttggaatcagtttttacacgtttcagattatggcgtacgtgattgatgtgtaccgcggaagaattccggcagaacagtcgctgcttcggctgggaacgtatctgaccatgtttccgcagctgatatcgggaccgatcacaaattatgcggatgtgcgtgtagcattgggaagagagcgcacgatcaaggcacgtcagctggaagagggaatgaagctcttgattatcggacttgcagcaaaagtcgtgattgcggaccggatcggcacactctggaacagcatccggatgatcgggttcgacagcatctcaacaaagcttgcatggatgggagcgttcgcttactcactgcagctgtattttgatttcgcgggatattcgatgatggcgagaggaatcggaaagatgctgggatttgagctcccggtgaacttccgctatccctacatttcaaaatcagtcacggaattctggcgcagatggcatattacgctcggcagatggtttagggaatatgtatacattccgctgggaggcaaccggaagggaaaggcgcgcacctttttcaatctgtttgtggtgtggagccttaccgcgttgtggcacggggcgaattataacttcctgatctggggcgggattctgctttgctgcctgttggtagaaaagctctttctgctgcgcctgctggataaaagcagggtgatcggtcatctttatgtattgtttgttgttccgctcagctgggtggcgtttgcggtcaccgatctgtcggagcttggcgtttatatgacgcggctgttcccgtttgcggggcatgcggcaggagtcatcaatcatctggattatttaaaatatctgaatgactatgcaccgctgtttcttctgggcgtgctctttgcaacgccgcttccggagacctgctatcggctgatcgagcgcaaatggatcggcagggtgatactgctcggcattttcgggctttgcatgtactatctggcggtgtcggcaaacaatccgtttttgtactttaatttttaaatgtgtggtggatggatttgagaaagcttttgaaatgtccggtaacggtcgcactgcttatcttgtgggcggcgctgtcggttgtcggctatctggggaaagatacaatatataagaattatacggttgatatacgaacgacaccatacttcgtcctggtgtttgacggactgcatgacggaatttttccgtggagtcatgtgggtgcgccggacggcataggagagaacggaaagctgccgtccatcctgctgccgggggagagtgtctctgatactgagcttgccggcgggacggagacggtcggagagacagagacggaagaggcgccgcacacgcgggaattctgtatggtggatgacgactggttcgacgacgcggtctttatcggggattcgagaactgtggggctgcgcgattacggcgggctggacaatgcgaccttttacgcgtccacagggcttggaatctacgatatgtggacggaaaagttctgtgaggtggacggggagaagaccacgcttgaggatgcgctttccagacggcagtttggcaaaatttatttccagatcggcatcaatgagatgggaagaggaaccctggacggttttatggagcagtacgcgcagtcggttcagaaatttagagaactccagcccgatgcgatcatctatgtgcagggtatcatgcgggttgcaaaggccaagtccgactcggacaaaatttttaacaatcagggaatcaatgaacgcaatatgagaattgcggaacttgcggataatcagactattttttacattgatgtgaatgatgtcgtatgtgatgcagacggaaacttaagagcggatctcacgtttgacaatctgcatctgtacggctcgaaatacggaatctgggtggatttcctcaagacgaagggaattgcaccgtgaagtggttcttctgaaaagaaatgagaccctcgtctcttagatgacacagctcgttcgacatggcgctccggtctacggagagatagtcggcgagctgttgtctgttaaagggaatatcaaaagacgaacttccggatctgcgcgcctcgctcgacagataggagagaagcttttcacgggtggtccgcttggtcatgtgctctaatttctgtccgagctggaaattgcgctcggcgagaacggagagcagatttcttgtgagctggttgtggaattcacatgcgcgggagcagagcgtcatcatttttgagacgtttaagtagagcacagtggaattctgctcggcgtagaggctgacttccagcgcacagtttgtacggatggcataagattctccgaagatgtctccggggcggcagcgggtcatcagatttgtgttgccccagaaatcctccttcatgacatccacacatccttctaccacaagaccgagagaatccagatggtcgccgtagtgaaagagaaagctgccctttggataggagagggtctttgccgacagacagtcgagcatggcatggatttcttcgggtgcaatatcataaaaaacgggagaggcctgcaagagggcatcgtatccttggaaagtttgcattatttttcgtcctttcgactttttgttgtaaaaacaacagaaatgttgacgctattgtagtatcctgtggaagaaaagtcaagagagaatttccggcatgcgtgccggagttagaatggaggatatgatgttacgaagagtcattgagattgaggaagaaaagtgcaacggctgcggagcatgtgcaaacgcctgccacgagggagccatcagtattgtaaacggcaaggccaagctgatgcgggacgattactgcgacggacttggcgactgtctgccgacctgtccgatggatgcgattcattttgtggagcgtgaggcggcggcttatgatgctgcggcagttgaggagaataagagaaagaaagcagcgcagcaggcgatagcgtcacagccgcttccgtgcggatgtccgggaacccaggcgaagacgatccgccatgagcagcaggcagtctgtccgaccgccgcagaagagagtgcggcagaacttacgtcggagctgacacagtggccggtgcagatcaagctggttccggtgcgcgccccgtattttgacggagcaaagcttctggtggctgcagactgtacagcgtatgcgtatgcgaatttccacaaaaaatatatccgcaatcacatcacgctgatcggatgtccgaagttagacgatgtggattattcggagaagctgacccagatcattgcgcagaacgatattaagagcattaccgtggttcgcatggaagtgccgtgctgcggaggaatcgagcaggcggtgaaaaatgcactcgcggcaagcggtaagatgattccgtggcaggtagacattatctctacggacggaagaattctcgagtaatactttccccttttgcgggacatactatgatgcagaagtatgttacgcgaaaggggattttttatggcacttactatgaaaattacagaggtacacgcgcgggagatcctggattcccgcggcaatccgaccgtggaggtggaggtgaccgccgagacggagacaacggggagaaagactacagcgcgggagtcggttccgtcgggagcgagcaccggaagatttgaggcagtggagcttcgggacggcgacagggagtatttcggactgggcacgaagaaggtggtggatcacgtcaatacaaagatccgggaagcgcttcttggaatgaatgttttggatcaggcacttatcgaccgcagaatggtcgagctggacgggacagacaacaagggaaatcttggggcgaatgcgatcttaggcgtgtcgctcgcctgcgcgaagacggcggcagcggcactcgatatgccgctttaccgctatattggcggaggcaacgccaagcggctgccggttcccatgatgaatgtcataaacggcggagtccatgcgaagaattcactggattttcaggaatttatgatcctgcccattagcgccaaaagctatcgggaagcgctgcgcatgggcgcggaggtatatcatttcctgcgccagattttaaacgaggagggatatgctacggcggtcggcgatgaaggcggctttgcgccggatcttgcggatgccggtgaggtgttccggtatctgggaaaagcggtggaaaaggcgggctatacggtcggaaaagatgtggtctacgcgatggatgctgcggcgagtgaattatataatgaagagacgggaatgtaccatttcccgggggagaatggaatctgcagggatgcaaaggagatgatcgcgctctacgaagatctggcaaagcgttttccactggtgtctatcgaggacggtctgcaggaagacgactgggagggctggcagagtctgaccggacgtctgggagatggcatgcagcttgtcggcgatgatctgtttgtcacaaatcccaagcggatcaagtgcggcatcaaattaaatgcgggaaatgcggtgctgataaaggtgaatcagatcggcacgctgacggaagcgctggatgccatcgagatggcgcagtgtgccggttatcacacggtgatctcccaccgttccggggagacggaggatgcgtttatcgcggatcttgcggtcgcggtgaatgcggggcagatcaaaaccggtgcgccgtgcagggcggagcgcaccgcaaagtataaccggcttctgcggattgaggaggagcttggcgagacggcgcagttttctccggcggagcctttcgggagagcgtaaaaaacagttgaaaacgcggggggagtatgctataatagctaaagttgtgagttgattaccgtaggagggaattattttggcaattttaaagacgattttaaccgttgttttcatactgatttgtttggcgttgacagtcattatcttattacaggaaggaaagtccgcaggactcggagcgatcgccggagcggcagatacgtattggggaagaaacaagggacgttccatggaaggccggctggtgacgggaaccaagattctggttgcgctgttcatcatcattgccgctgtattgaatctgggaatcttttagaaatgaggctgtcgcatctgcggcagcttttttgctgtggagaggaaggatatgagagaagaacttttacaggaacgaaaaaaagcaatttacggactgatctgcgatgagctttatgtgccgatgaaggcgaaggagatcgcggcagtattaaatgtgccaaagagtgacagaagagacctcgcggaagtgctggatgcacttgtggcggagggaaaagtggaagtgtcatcgaaaggcaagtacatgaagtcggaaggaaaattcctgacaggcgtttttaccgcgcatccgagaggatttggctttgtgacggtcgaggaggaggatgaggatatttttattccggaatcccaggtaaacggtgcttttcacggcgataccgtgcaggtggcgctgacacgcgccgaggggcacggacggcgcagagaggggcagatcacaaagattttgacccgcggggtcagccggatcgtctgtacctatgaaaaaagcaagacattcgggttcgcagtgccggataatccgagatttggacaggatatttttatcccgcaggagcgctcgaaaggtgcggtgagcggacataaggtcgtggtggaactgacggatttcggcggcaatggaaaaaagccggagggaaaggtcgtagagattctgggacatgtgaacgacccggggacggatattctctcgatcgtgcgaggttacgatctgccgaccgagttctcggagaagatcatgaatcaggtggagcgcgtggcaggtgaggtcagcacggccgatatggcaggccgcatggatctgcgggactggcagacagtgacgatcgacggagaggatgccaaggatttggacgatgccatcaccctgacgaaggagggggatgtctaccgcctgggcgttcatattgcggatgtcacgaattatgtgcaggagcgcagcgcccttgacgtggaggctctaaagcgcggcacatcggtctatcttgtcgatcgtgtgattccgatgcttccgcatgcgctttccaacggcatctgttcgctgaacgccggggagaaccggttggcattaagctgtatcatgaccgtggatgcgaagggaaatgtgatcgatcacgtgattgcggagacagtcattaaggtcgaccgccgcatgagttacaccagtgtcaaaaagatcctggaggatcacgatgaggcggagatccgtgagtatgaggagcttgtgccaatgtttgagaggatgcgggatctggcggcgattctccgcaaaaaacggatgaagcgcggatcgattgattttgatttcccggagacgaagatcattctggacgcgcagggacgccctgtggagatcaagccgtacgagcgcaatgttgcaaccaagattatcgaagattttatgctgcttgccaacgagacggtggcacaggactatttctggcaggaactgccgtttgtgtaccgtacccacgacaacccggatacggagaagatccacaagctggcaacgtttatcaataattttggctattcgattcatatcgggcaggatgaagtacacccgaaggaactccagaagctgctgcttcggattgacgggacgccggaggaggcgttaatcagccggctgacactccgctcgatgaagcaggcaaagtacagcaccgtaaacaccgggcatttcggactggcaacttcctattactgccatttcacctcgccgatccgccgttatccggatctgcagattcatcggatcatcaaagacaatctgcgcggaagaatgaatgcgaagcgcatcgagcattatgagaagattctgccggaggtggcaaagcattccagcgagatggagcgccgggcggatgaggcagagcgcgaatgtgacaagttaaagaaagtacagtacatgtccggacatctgggggaagagttctggggtgtcatttcgggcgtgaccgagtggggcttctatgtcgaactgccgaataccgtggagggacttgtgcatgtgacgacgctgacagacgactatttccactacagcgagagcacctatgagctgatcggggagaccaccgcaaagcgctacaagcttggtcagaaggtaaagattgtcgtggcagcgacagattcgtttatgcgaacgatcgactttcgtgtcgttaccggaacagaagacgaagaaaatgaaaaattaaaccagaagtttattgcagaataaaaatttgtggggtatactgtaacagcagtgcagatgaaaagcggcagtgcagacagtaagcgaaggaggatagtcgggatggcaaagaccgagaagaagttaatcgcgaataacaaaaaagcctaccatgactatttcctggaggagcggtttgaggcgggcattgaactgcacgggacggaagtgaagtccatgcgcatgggcaagtgttcgatcaaggaagcgtttgtgcgcatcgagaacggtgaggtcatcgtctacggcatgcacgtcagcccttatgagaagggcaacattttcaacaaagatccgctccgccccaagaagcttctgatgcacaagtcagagatccggaagctgacgggaaagcttgcagagcagggctacacgctggttccggtggaggtatatctgaagggaagcctcgtgaaggtggagattgcacttgccaaaggtaagaagctctacgacaagcggcaggacattgcgaagaaagacatgcgccgcgaggcagagcgtgatttcaaggtaaagaatctgtattagattttttataaataacaggggccagtaaaggtttcgacggggaatatgaagctggagaagcgagccgcacgggatgcgtcaaattccacaattaaatttaaacgctgaagataatttagcatacgctgcctaatggcagcagtctgacctagagcactcacactttaggacccaggcttcgacgatgtgagaaacgacacaggcaaagctttgagcctgcgggcgtaccatgaagctaccaaaaccgtaagggtgtctgttcccggacggcagagggaatgtcaaaggacagactaagctcgtagaaggacaggggattattcttcggacacgggttcgattcccgtctggtccacttatcaactatgtgacgaacccactattcgcattatgctttatgagaatatgtggcttgtatcgaagataatcgcatgattggtgatgtagaatgaaaaaggggcgtaagccccttttttatatgattgtaaatagtcgaaaaactcaaaacaggctacgggggtttttagactatcaatatttattgactgtctaaaaactgtttgacagtctaaaaacttctaagccttgtagattctggggttgacggcattttgtattaacatttttattctctaagaacattgttttataaaaaaagcgtccccatcgtccccaaagtggcgcaaagccttgtaaatactacgcacaaggctggggacgctccacgccaaggtagcgtccccaagcgtccccaagtcccccaagcgtccccaagtccccaaaacgtccccagcctcaaaaattgtaaatagtcgaaaaacgtctttgtggcaacatggttttatcataaacggaaaactattgaataccaaacgtttttgcaggaatatcaattcctaccatttttccgaaagccaatgcccatttgacaaaattgtatgatattgatgtgattatattgccagttataatatatccatccttaatgggcttgtttatattgtcatcccagctcaccatttctgctaaatcactttcggaaaatccttcttcaaaaatctcttctttattgacaccagccatgaacggttttccattaagtaatccggctctgacaagtaacagaggtgcaattgaaatagctcctattgtttttccgtcaaactttttgatgaaatctattatttttttgttttcaatagcctctctgatatccattgcaccaggcaatatcaagctgtcatacgcatccaaatcaaaattatcaatagtagcatcgggaattactgataatccatcttcacttctgattgcctgttttgaaatcccaaaaattgtaattggtttttcagcgagtgccaatatctcaagcgcaggactgatttcaaaattacaaaatgaatcatataataatacggcagtttttttcatatcaattttcctccatatacaaattcagtctggtaaattacctttttaattgtaccatatagttctaaaaactcaaaagattattttgctcacttttcccgtgtttactgagaaactgcttattaagaaaggattgtaaaaggtcgagatattgattgacactgtctaaaaacagtagtattctatttgcaacaacatataagcggtgttcacgaagtgcgtgcatggtttgaacgataagttcatgaagtctatgagggtgcagactaaactcgtaagacaaagttttatatgctccatgtcagctagtcataccagctgtgagaacaagcagttgcgaagttaaaagcggtgaacaggaaagtgtatagcatagctatacgttttcctgtctgccgcttttttgtgcctaaaattatttaaaggagtgacgacatgcttgaaacaagaaaaggtggacgaccgtcaagacgacctgataaagaaacgctccagcatttatcagacatgctgacaatagagcagattgctcagctctattgtgttgaccgttctactgtttgtaactggaagaaatattatagactgccaccaaagattggacgcccaacaaagcgtccgtcagcacgcaaattaagaaatctgtgcaaaacatgttcttacatggaaattggtgggcgtttaggtgtttcacctagcacagttgcatcatgggtatatttctaccgccagaagaatgagaagaaaggtgtgtgatgcgttatgaatgacatgtttcttgatgatataaaaaaagatgtgtccgtgactacctacacagacacatccacaagtgctatacacacttatcctgatgacgcaattataactgacattataaactgtgtcaatactgcttttccagacaccagcagacaacagaggatgatatatgttcataaaatcataaattgtcatagaccatacagtgacggtggcattgttcctaatccattgactgataaagatgctcagaactatacgattggatttaggtcaaagttgcgacagttcgcttttaaaatctatattgaacagttgccaaatggaattattgattttataaagcgtgtgcaaagtgttgaaaaaacaacgtatcaagtgattgcgattatccatgacagagatataaaacttgatgtgcatgacttgtatgcagaagcaaggttaaaaccacacattcacattattgtacgttgtactgacagtaaaaaacgtgttcacgttcagactgttatgaacatgcttggtattattttccgaaaaggcattgatgatgcactgatagtacgaaacaagggcatagatacaattcataagaagtttgctattgcaacaacttatctcacacatgatacagaagatgcggcaaaacataaggaacattatgaacttgatgagtatataagtaatctgtccattgaggaaattcagacaatcagggatggatatacaaggctgacaacatcgacgaacaaagttgataaacaacgcatggctgaactggatgaatatgcttttaatataggctatgaattaaaagattttgatgagtggtacaataccttatcatttgctgagcgttgtaatgctagtatgaaaactgtgcaggaaagttatatgagagggtgtcagaaaaaatttgatgaacgtgtgccaattttacgcaaatgtattttcattcatggtgcgccgaatactggcaagacttatgcgactgaacgggctttggcaggcaggaaaacattacatgttggtggcggtggaacaggtaaatttgacagtttaaaaccaagtcatgatgcaattattgttgatgatgatgtgtgtcctaatctattgaatatgtcggacaattacgcatgcaaagcatacagacgaggcagaaataatcctatctgggctggcgagtggcttattgttacaagcaacttaccttttcgcgagtggcttttcaaatgcggtttttcttacaaagaagaagattcacacgtaaaggcaatgttctcacgattttttgtatgcaaagtcgtgggtgatgatagttctgctgaactttatctgctaaatccaagcacacggggattggtcgaggagcagaaacaacgcatgagggattttctacaatttcagaaagtctttaatgatacaatccaaaactatcatgcagagaaaagcagaaatgattttgatgcttttgcttttgtaacaaaccactgtccgttcggtgactttccagaacgacaaaaaaaggcatttgctagtctttatgacaatggttcatagaaaggagaagaacatgaaaacggttaatcaattacaggcggaacttatgaaacagaaagaagcatatcagacttcacagaagaaattaaaagcggagttgcgaaaggcacagaaagaagctgagcgtgaagcacgaattgcagaacagaagaagatgaacgaagaaaataaaatcgtatgcgattttcttcgtactaattttggtcaggatggtgtgctattgttcgatacattacttcaacgagcaatgcaggcgaacaatgagaaacagtcgtaatgcgcgaaaaagggggtaggcttcgccagggggatttccccctatgagaagggtattgcgggttgcttgcaaccccaatgcccagttacattgggattagaactaataacaatgtaatgaatatgctacggagatagataatctacagaaagaggtgtaacttatgggctttcaatgctgtccgcaaataatgggactacaacgacaggggcatgttacaaaatcaaacaagcgaggtgctggaaaatttatatgtgctgagatgggagcggataggatttcatcgagtgaaataatcagacatgaagattcaaaacacaacacatatacaaattatattgatggcgaaaacttttccagcggtttcaaactctgggactatatcgagaaacagggagatactattgaagttaagtgtacagacaaaagaacgggtcaggaagttataagatatagaaaatcaaaggctgacgctgtgcttggttatgcctatgttattaagccgccggctgaggtaacagagcaatggacggacgagcagaaagcgaagttctatgaagatagttttgatgctatgtgtgagataatgccagaagtattttcacatgagaataggctgttcactgcgatacatgttgatgagggattctcccttgcggatgagcatttacatggtgcaggaataccacgaaatgctgatggcaagtatacaggcaatttgattgatgccaagcatctatctttgatgcaacaggaattcccgaaacacatgcgtgataaggggtgggatattgaagataatgatgtgaccgactggcaaaagtataatactgataaacaatatcgtgatgagcgaaaggtttatcttgaacagaaaaagaaagatggaaaaggtggattgacaccgaatcagtaccgcaagtttttggcgcaaaaaaaattaaatgaggcgaatgaaattcttattgatgcaaagtctaaactgggagacgctataaaaacttataatgatacgcttgctacgcagaaaaatattaagcatgaaatagatgttcgagctgatgcattggctgaccgtaaagcagaagaaacgatacaacagtacgagcgcgagtttgattatcgtgtcaatgcaaaagctcaagagattactgcaccgatacaacaaagttgtgaatgtgcgctgaaagattataataatagaattgcgaatattgataatgctgttgaagaacagatgcgtctttacattgaaagtcaaaaaaatgaggatacgcctgaaatgaaacgagtgaaacaatttcttgcgtctagggttagttccaaaactaaaaaaagcgaactggatgtatataacgaatatgcacagcatcatccactagatagaacagagcgcatacgacgcgacacacaaagaattgcagatgcagttcggaatactgactggtctgcatcccaatggcagttagactagtaaaaatcatattgcaaccctgcaccccgcttgctataatccaaagcagaaaggggtgctttttttgaaaaaatataaatataatgacaataaccttgcaatctgttactatcgcttttcatcacatgctcaaaatgaagcgtccatagaccaacaacgagaacaggcaaaattttttgcacaaacgcatgacttaaaaatcataaaggaatatagtgatgaagcaatctcaggaacgacagataaccgccctggatttcaacagatgctctcagaagttgcaaagctgaaacctagcacgcttatagtttggaaagttgatagattagggcgagacagaactaatatcgcgattgctaaagatactttgcgaagagcaggttgtcgtgtcaagtatgttgcggaaacagtggcaaacgaggacacaccggaatcacagtttactgaggcgatgttagagtcgatggctgaattttattctgcacaacttagggttaatgtcatgcgaggtatgaggtataatgctgaacatgcgctgtataatggtcacaagacactgggatatgctgttgacggtgaaaagcattatgttatagacgaggaaacagcaccagttgtccggcgtatctttgaacaatatgcatcaggtgtgccaatgcaacagattatgaatgaattaaatgatgcaggaatcaagacaacacgtggaaatgaatttactattaacagtttacgtcatatcctgcataacagggcttatataggcgagtatcattataatgacatagtcatacctgatggtatgccctctattatcccctgtgagctgtttaaaacggcacaggaacgctttgaactgaatagacggataaagtgccacaaaagcagtacaatggctaaaaacgtctctgagagccgtttctggctgacaggaaaactatactgtggaaaatgtggggaaagcatgcatgggctatcaggaacgtctaaaacaggtgctacgcattattattacgcatgcaataatcacagaaaacacaagtgtaccctaaaaaacataccgcaacatcaaatggagcttaatgttatatcaattttgaaaacatttttgaatgatagtgagaatcttgcatcgttggctgtagacatagcaaattaccacaagagccggaatgataattctgcttttattgccagtctggaagagatgcttaaacagaatgaaaagcagataactaatattgtgaatgctattgctaatggcgcaatgtcttctgcgcttactgataaactccaacagttagagatagaaaaaggttctttgacggatgcaatcgaagtggaacaggcaaaggcaagactaattgtagatgaacattctgtaaaagagtattttaagcagtacgctaatgcaaacttagatgatgcagaaataagagattctgtattgaattattttgttgataagatttatgtctatgatgataaaattacagttacaggctgttttagtggggaaccgacggaaataccgtttacagagttttcagagttcgactgcgaaacagtcagctccatcttaaaaagcgccatgcagggcgctttttttatgggaaaatgcggaatctttacatctccctgacttgcaattcacactgccatttcctataataagagcaaaatcacagcagaaacggaagagatgaggatcgaagaatgtctgtagaaaagagacaaaaagaacaggaaaagacctccatggtcgtggagggatttttatttgcaaatgaggcggaagccgcgcaggcgagaaaagaggcggagggcgtgaaatacgtcaaggagaaagcccagatggacgaccctgagatggtactccgcatttataataaaatgatacagcagcggctgtttgacacggcagtcggctattcttatctgaaggatctgcaggagtatctgcagtcgattccgtttatccggaaggaagatattttcccgattccggtgcagcatccgcaggtggaggagagtctccgcaaggcgaagcgcgcgccggcaccaaagccgaagacgcagaccgtggtaaaaaatgcggactacaggagacgctaccgcattgtgcgctggatcgcctttattctggcagtatgtgttgtggcgatgtttgcaattacggcgacgaccaataatacgacggtgttaaactacgagaatcagctgatcaacaaatacgaggcgtgggaggagcggctcgaccagaggcaggaagcgatcgaggcgaaggaaaaagagcttggaatcatgccggaatagagcggaaaatacacagatttttcataagtagctgttagaatgacgataaaaagcggaaaggatacgggaacatggataagatcagaattctggtggtggatgatgagagcagaatgcgcaagctggtgcgggatttccttgtgagagagggatacgaggtgcttgaggcgggagacggcgaggaagccctcgatttattttaccgggaaaaagacatagcgctgattattttagacgtcatgatgcccaagcgcaacggatttgaagtgtgccgggagatccgggagacatcgaaagttccgattattatgctgacggcgaagggcgaggagagcgacgagctgaacggatttgaactcggtgtggacgaatatatttccaaacctttttctccgaagatactggttgcgcgtgtcggagccattctgcgccggagcggaaagacgcaggatgaagaagcggcggtctccatgggaggaatcgttctggacaaggcagcccacatggtgacggttgacggagagcggatcgatttaagctacaaggagtttgaactgctggcatactttatggaaaatgcggggattgcgctctcacgcgagaagatattgaacagcgtctggaattacgattactttggcgatgcgagaacgattgatacgcatgtcaagaagctgcgtgccaagatgggagataagggaaaatatatcacgacggtctggggcatgggctacaaatttgaagtgacggaagaataatggaagtgacgcggaatgaagggactttttgataaaaagagacaggggcgcggcagacatccgaaagagggcggactgaccagggaaatcgccggaattatcatcggtctggtggcgggaaccgtggcgctctgctgggtgcttaacacggtatttctggagcgctactatgtgatgaacaaagaaaatgtactgctgtccggatttactacgattgacgcggcaagcgaggatggaagccttgacgacagctcgtttgatgtgacatttgacaatctctgcgcaaacggcaatatcacggtcatggtgatcagcccggaccgcacgattgtcagatcctccgtgaacgatacacagcgtatgttaatcgagtttacggacattattttcggtggtacgcagaatgagaccacggtgctggcgcaggcggaggactatgtgatccagagaagaacggacaccaggctggatgcggaatatctggtactgtacggaaccctctcaaacggcaatctggtgctgatgcggtcggcgttagagagcataagggagagcgccaagacgtcgaaccagttcctgctgtacgtcgggatcctggcgattgcggtgagcacggttgtgtcggtcttcatctctaagagaatcaccgatccgatcctggaactgaccgagatttccaagcatatgacccagctggaatttgaggtctgctatacgccgaaaggaaagcggcgcaatgagatcgatgaactcggcacgcacatgaacgagatgtcgcaggcgctcgagcatacgatctcggaattgaaaagcgcaaacaaccagctccttttagacattgagaaaaagacgcagatagaccgccagcgcaaggaatttctctcgaatgtatcgcatgaattaaagacgccgcttgccctgatccagggatatgcggagggcttgaaggaatgtatcaacgatgacgcacagagccgggatttttactgtgaggtcatcatggacgaggcggataagatgaatcagatggtgaaaaagcttctgacattaaaccagctggaatccggaaacgagacgatcacgatggagcgcttcgacgtaacagagctcatccggggcgtgctgcactcggtggatatcctcatcgggcagagcggcattacggtgacggaatgtcccgcagagcccatttatgtgtgggcggatgaatttatgacggaggaggtcgtgacgaactacctgagcaatgccattcattatgcgggaggaaaaaaggagatttccatccgctgcagggagcaggagaagaacgtccgcatcagcgtcttcaataccggagacccgattccggaggaggatatcgacaaaatctggtccaagttctacaaagtcgataaggcacgcacgagagagtacggcggcagcggaatcggtctttccattgtgaaggcgatcatggactcgttccatcagcagtgtggcgtgatcaaccatgaggatggcgtggaattctggtttgaactggaaaaaggaaaacagtcatgatgcagcaaaaaattttttttgttgctatatttcctttaaaatgctaacataatgttagtttatactttgcgtgaggaatggagtcctatgagaagaacaagaatcaagatgatggcagcggtgatggctgcaacgatgctgttgggcgggtgtggtgatgcactctatgacctgacagacgacgaggagaacgtcattgtcaattatgcggcgcatatcgtcacgaagtacaacacatatcagcgggaaggtctgacgtatgtgagtccggaagaaccggaggagacgcaggaggatgtcacggtgccgcagacgccggagacacaggacgcgtcagagacgggaacagccgcatctgcggaagctgcggcacctgctgtgtcggtggcggcagccggatcggcatctctggatcaactgttcggagccgacggcattcagatgacctatgcgggcgcgcagcttgcaccggggtacatggaaggtgattattatgagatgaccccggatgccggaaaacagtatctggtgctgtccatagatgtgaccaacaccggggcggacggagtgggtcttgatgttttgagtgtcagcccgaagttcacggttgtattgaaccagtcggtcaagagcacggcggagaccacattgctggatacggatttttccacctatcagggtacgattcctgcgggagggagcacccgcctggtacttgtattccaggtgccggatgatgtggcgtcggcagacagtgtggaactgtatgtgcaaatggatcaaatgatacaaattattctgtaaaacgcatgaaaaacaatgcatttcaggtaccaatgtgctataatgctgtcagatagatacgttgcggtattacgcgagaggagagagacgaatggatacaaatatattattggaatcgggaacaaacgaactggaagttctggaatttaccttgggaaacaatcattacggaatcaatgttgcaaagatcagggagattttaacctatcagccggttacgcctgtcccaaattcacatccgagtatcgaaggaatcttcatgccgcgtgatacgatgatctctgtggtaaatctgaagcgctgtctgggaatgccggatgatgcgaagacagagggactttttatcattacgaactttaacaagttaaacattgcatttcacgtagatgccgtgcttggtatccaccgtgtttcctgggaggcgatcatcaagccggatgccacgatcaataccgagcagaacagcgcctcgaccggtgtcatcaagatggatgacaagctgatcatcatccttgactttgagaagattgtgacggacatcagcccggagacaggactgaagatgtccgatatggacgacatgggacagcgtgagcgctgtgaatctccgattttgatcgcagaggattccccgcttcttagcagactgatcacagactgcctgaagaaggcaggctacacgaacctgattgtgacaatgaacggtcaggaggcatgggataagctgcaggagtttgaaaaagcaggcaatgtgcgtgagaaagtacactgcattatcacagatattgagatgccgttgatggacggacaccgccttacgaagctggttaagacaaatgacaatatgaagaagattccattgattattttctcatctcttgtaaatgaggagatgcgcatcaagggagaacagcttggagcggatgcccagctgacaaagccggagattggcagtcttgtttcggcgattgacgacttgattgacaagagcatggactgagaatgaaatgaagaggggatgtgatggagcaggatcacatcccccgcttaagttataggtcgatggaggtatcgtatgagcggagcagaggaatatctggatgggctgctgcactccgtagagggaggaagtcctgccgacacagcccgtgagacggagccaggcgatacggcagacgggctttatgcagaaaaagaacaggagacaaaaaaagctggtatgagtgaggaagacgattttttaaagtcctttgaggcggatacagatctggaaggagatgcggacacatttatcagacagttcgaggatgagctggatcaggcgcctggagaggaaagaacacagaagacgacggaggagaacaatcagttcttcaaggatctggatggcattttagacagcgcaagggatgcggatgagagcaccggcggtgcagaagcggcggagactgcccatgcgtcggaggacggagatcttatggtcgataccattggtgatttccaggacgacgattcagatctgatggatctgctgcagtcggagggcgatttcccggatatgagccagatggcggatcccactgctccggccgcagacacagacgcagaaatgccggacgtgacggcaatgccggagactgcggatgaggtgcaggacgaggacgacgggaaaaagaaaaagcgccgcaaaaagaagaaaaaagatgagccagatgccggggatgaggctcctgcaaaggagaaaaagagcctgatcaagagaatcggcgacgcactgtttggtgaggaggaagagacggaggaggcaccagcggacaccggggaattacagccggaaggtttagaacaggcaccggagctggatgatctttccgatgagaatttaaagctcttacaggaactggaaggaacgggggcagccgagccggagacagaggcggaaccggagatttcagaagaagagaagaaagcgcaggcaaagaaggaaaaagcagagaagaaggcgcaggagaagaaagagaaggcggagaagaaggcacaggcgaagaaggcgaaggcagagaaaaaagcacagaaagccaagaagccgaagaagccgaaggagccggacaatacaccgccgcttccgaaaaagccggtggtgctgattatggtcatggcggcgtctttcctcgcacttgtgctggtgggaacgaatctgttcggatataccctgagcttcaacaatgccaagcaggcgtatgaactgggcgactatcaggcagcgttcgcggatgtgagcggacttacggtcaaggaggcagatcaggagacctaccagaagtacagcatcatggcgaatgcagccggagaatatcaggcataccagacctttatggaaaacggtatttatgacatggcactggattccctcatccgcgcggtcggaagatgcgataagtacagcgaggaggctgcggcttacggctgctccacagaactcgcgaagatcagagaccaggcggtggcaggactgtccggatttggacttacgcaggagcgcgcacaggaactgtacgcggagagagagcgggatacttactcgcaggaactgtattcgatattggcggcagcaggacttggatgacatcgacggagtgagagaatgatagcaattatagactatgacgcaggcaatttaaaaagtgtggaaaaggcgttcctcgcgctgggtgaggaatgtgtggtcacgagagatcatgacagcatacgccgggcagacagagtggtactgccgggtgtcggttcttttggaacggcaatgcagcagctgaaaaaatatgagctggatcaggtgatccgcgaggttgtgcaggaagacaagccgtttctcggcatctgtctgggtctgcagctgctgtttgagggcagcgaggagagtgacggcgtggagggacttcatctgctggacggagagatcgtgaagattccggaggcgccgggacttaagatcccgcacatcggctggaattcactggatttcccgcatgaaggaagattgtttgccggattgaaggaacagccgtatgtctattttgtacattcctactacctgaaagcgaaagatccgtcgattgtgaaggcgaccacagagtacggcgtgacgattcatgcttccgtggagaagggcaacctgtttgcgtgccagtttcacccggagaagagcagcacagtgggacttcagatactgaagaattttgcggaaatatagcggaggcatgcgatgtttacaaagagagtgattccctgtctggatgtgaatggcgggcgtgtggtaaagggtgttaattttgtgaatctgagggatgccggagatccggtggagattgcggcagcttacgataaggcaggtgcggacgaactggtatttctggacattaacgctacctcggacgccagaaataccgtggtcgatatggtgcgccgcgtggcggagagagtgttcattccgtttacggtcggaggcggcataaggacggtggatgattttaaggcactgctccgcgagggcgcagacaagattgcgatcaattcttccgcgatcaaccggccggaactgatctcggaggcggcagacaaattcggcagccaatgcgtggtggttgcgattgacgcaaggagacgcgcggacggctccgggtggaatatctataagaacggcggacggattgatgtgggtctggatgccgtcgagtgggcgatgaaggcagaccggcttggcgcaggagagattcttctgacaagcatggactgcgatggcacgaaagcgggatatgacattgaactgaccagacaggtcgcggaaaatgtatcgattcctgtgattgcttccggcggcgccgggacgaaggatcatttttatgatgcactgacaaagggaaaagcggatgcggttcttgcggcatccctgtttcactataaagaacttgagattatggatctgaagaacgatctggcagcgaggggcgtatctgtgcggcgatagcacggtgcgcccacactgctgtctgtgaaaaaaggagtagtgggatatgtcgatgattgacaatgactggcttccggcaatccagggggaattccgaaagccgtattaccgggaattatacacatttgtgcgggaggaatacagcagaacagtggtctacccgccggcggaggatatctttaatgcctttcattttacgccgcttagtgaggtgaaggtgcttctgttggggcaggacccctatcacaatgtaaatcaggcacatggtctttcgttttccgtgctgccggagcaaaaggagatcccgccctccctacagaacatttataaggaactgcatgatgatctgggctgttacattccgaataacggttatctgaaaaaatgggcagatcagggagtgcttctgctcaacaccgtcctcaccgtgcgcgcgcaccaggcgaattcccatcagggaagaggctgggagcagttcactgatgcggtcattcaggcagtaaatgcccaggatcgtccgattgtgtacctcctctggggcagaccggcgcagtccaaaataccgatgcttacgaatccgaagcatctgatcttaacggcaccgcatccgagccctctctcggcataccggggatttttcgggtgccggcatttcagcaaggcaaatgcgtttcttgaggagcatggaatcgcaccgatagactggcaaattgagaatatttagtgtataatatacttacaataaaagcagacaggaggtattggttatgcgtgtaaaagcaattatgatgcctttcagtaagctggcgtgtatcagcgtggagaatacggtagaagaggcaatgaagattatcgacgagcagggacttctctcgcttccggtagtggacggacagcagtttgtgggtgttttgtccaaacagtttttgtttgaggaatttttccggaactatacagggaccagagaagaatttgcacagcgaaaagtgatggagttcatgaagacaagaattgagaccatcggtgagaatacacggattgaggaagcggcagcaatgtttatcacctccaaagttcgttttattccgatcacgaacgagcagaacaagctgcttggaatcgtgacgcagcaggcggtattcaaggaatatcagaagatctttggtaacaaacacaattccatggcaatctacacgtatgatatccgaggtgtgctcggcaagatctgtgagctgattgctaaggagggcggagacatctgcaacatgatggtgattccgacggatgttatggatctggcagagatcttccttcgggtggaagcaccggattttgagcgtgtggtacgcgcgttagagcgccacggttatgatgtgcgtgatgtgaagtataatgatcagaaataatacagaacggatggatctggaatagaagagaggggtgccgcgcatgtgcggcgcccctctctgtctgcataaaagggagctccctaaaatgaggagtgcccagacactcgcgcgcctgggctattatgaaaaaattatcaaatatattgtaacgaattgtcttgttttttgataattttattgtagcaataagatatgaataaactatgaacaatagttaaacattttaataaggacaagcaccagaaaatgcttgaaaaatctaaggtttcgggctaaaatgacgatatagaacatgaggtaacaagaaggtattgtgcacaaatgcaacagccggatcaacattctgacacggaggtcagatgctttttttcaaaggagtgatagagtatggcaagtatttcaggatatgattcatcgtcactgggcgtgttattttccagtctgaaccggaacaatacaacttcctctctgctgggaggcggaagcgatctgctcggaatcaattattccgattatgcgacgatccgcaacggaagctatttcaagcttttgagtgcctattacagcaagtcggattccacggacagcgccacgaaggtcagcccgtcgatctcaaccgcgaaggatgacgcgaagacactgacccggattgagagtgcggcggagagtacggagaagtcgctttccaagctgacagcaaccggaaaggattctgtgttcaacaaagtggagaagaccgcggaggacggcacgaagacgcaggagtatgaccgtgatgccatctataaggcggtgaagtcgtatgtggatgattacaattcactgctggatcgggcggacgattctaagacgaagagcattctgcgtgcggcgaactctttgaagagcaacgccagagcgaatgagaagacgttggagaaagcgggcattaccgtggatgccgacggcagactttccgtggacgagaagagctttgagaaggcggatatggacaagctgaagtcactgtttacaacgcacggatcttatgcgacgcagacgaatgtggatctcctgaagatcgcatccaacgcgaagagtgaagcggcgaaggcgaatacctacagcaagaatggtatgtatacttataattacagcaccggagatctttacaattccggaatttaacattggaagacacgaagagatgaggctgccataccgtaaggtgtggcaacctcatatgtttgttggcaggagcgggcatggcaggaaaaaaagtagtagtcggtatgtcgggcggagtggattcttccgtggcggcatatttgttaaaacagcagggatatgatgtgatcggagtcacaatgcagatctggcaggatgaggatcagtttacacaggcggagagcggcggatgctgtggactctcggcggtggatgacgcacgcagggtggcggatcgtctggagattccgtattatgtgatgaatttcaagcgcgagttcaagaagaatgtcatggattattttacagcggagtatttaaaagggcgcacgccgaatccgtgtattgcatgcaaccgctatgtgaaatgggaatctctgcttcagaggagcttggagatcggagccgattacattgcgaccggccactacgcgcgcgtggaacagctttccaacggaagatatgctatccgcaattccgtgacggcggcaaaggatcagacctacgcgctgtttaatctcacgcagaagcagctctcccataccctcatgccggtaggagattacacaaaggatgagatccgtgcgattgcggaagacatcggactgatggttgcacataaaaaggacagccaggagatctgttttataccggacaatgattatgccggatttatagacagagagtgcggggaaatggtcccgccgccgggcaactttgtgtcggtggacggagagattttagggcggcacaagggaattacacattatacgatcggacagcgcaaaggactcgggattgcgtttggatatccggtgtttgtgacagagatacgcccggagacaaatgaggtggttctcggaagtgataaagatgtgtatacaaaccggctgtatgcgaatcagctgaactttatggcgctctccgacattgaggagccggttcgcctgaaggcaaagatccggtactcgcatgcgggaagctgctgcaccgtgcggcgcaccggtgcggatgagatctgctgtgaatttgaagagccggtgcgcgccgtgacaccgggacaggcagtggtgctgtacgacggagactatgtcgcgggaggcggcgtgatcacacacgcttaagcgcctgcatcacagggcaaacgtgcggattgcatgcgcgacgccgctgttttcattggagcgcgtcacaaagtctgcgatctccttcacttccggcagggcattttccatggcgacgccgatcgctgcggtttttaaaatgtcgatgtcgttctgggtgtcgccgcaggcaagcgtctcttcgatatcgacgccgaggtgcgaacagagcagggtgagaccgtttcctttggtgacgcccgctctggtgaattccagattgtggtagccgccggagagaaaggtgatctcggggtgctctgacaggatctgcatcacttcgtcgcggtagagaaaagtgccgtcctcctgcggataaaaattcagcgtcatcttctggacgttcagattgtggacgcggatataggcagcgagatcatcggtgaaggttctggtccggtgaatgtagcgtttgattgatgtgggcatgtccaggcagtcgatctttccctcacaggaacgctggctgaagccgtcgccattgataaaagcatccatatggatgctctttttttgcagttcttcgatgatggggcatacaagcgcaggctccatcgcagattcatggatgcagaggcggtccggcagatgatagacggcagcaccgttggaggtgatggcataggagacgccgagaccggataaaagtgtgacgggaagcccggcgtaagggcgtccggtcgatatggcaacgtgaattccgcgggaggaagcttcgcgaatggcgtcctgatcctcctttgagatctcactttgtccgttaaaaagagtgccgtccatatcgagggcaatcagactgacaggctgtttcatagtcgagtatcctttctgtaaatgtatctacagaatgatacaataaaatgggaaaacaatcaagaaacggcggtgccgtggcgcggattgcaggaaacattggaaaatacttgcacccggcatggggaaatggtaagatgtggcttgataagcgagaacggatgatagagaggatacgggaatgaccagagaggaatttgcaacacttgtgggaagcagaccggtgatattggacggcgcgacaggaacgaatctgcagaaagcaggaatgccggtcggggtctgcccggagcagtggattctggagaacccgggggttctgatagaattgcaggagcgctatgtggaggcgggcaccgatattttgttcgcgcccacctttacggcaagccggatcaagctggaggagtacggactggaggattccctggtgcagatgaaccgtgagctggtggcgctctcaaagcgcgcggcaggcggcagggcatatgtggcgggcgatctgacgatgacgggacggcagctttatccgctcggcgatctgatgtttgaggatctggtagaagtctacaaggagcaggcgaaggtgatctgcgaggcgggagcggatctttttgtcgtggagaccatgatgagtcttcaggaatgccgtgctgcggtcattgctatccgcgaagtgtgtgatctcccgattatggtgtcgctgacctacaatgaggatgggcggacgctctacggaaccgatccggcgactgcggtgattgtgctgcagagcctcggagcggatgctgtgggactgaattgctccaccggaccggaggcgatgattgatccggtacagcagatggcggagtatgcgacgattccgcttctggcaaagccgaatgccggtatgccggagctctgtgacggcgtgaccgtataccgtaccacgccggaggagtttgcgtcagtcggcgcgaagcttgtggaggcgggcgcggcgatcatcggcggatgctgcggcacgacaccggagcatatctgcgcattaaagcaggcggtgggttccatgccggtgcatatgcctctcacaaagaaaagacgtatgctcgcctcggagcggatgcatgtggagatccggcttgacggtaagttcatggtgatcggagagcggatcaatccgacaggaaagaaaaagctgcaggcggagttaaaagagggaagtcttagtatggtgcggaccatggcgacggagcaggaggagaacggcgcacagattctggacatcaatatgggaatgaacggaattgacgaaaagcagatgatgttagacgccatctatgaagtgacttccacggtagatctgccgctctgcatcgattccagccatgtggatatcatcgaggcggcgctgcgcatctatccgggacgtgcgcttgtcaattccatttctctggaaaaagaaaagatcgagtatctgctgccgatcgcgaagaagtacggtgccatgtttattttgctgccgctctcggacgaggggctgccgaaggattctgcagaaaagcacgggatcatccgcgagatcttaagacgcgcggaagcgatcggcatgggaaaagaggacattgtggtggacggactggtggcgacgatcggtgccaatccgaaggcggcgctggagtgttttgagacattttctttctgcaaaaatgagatggaactgccgacggtctgcggactgtccaacatttcgttcggacttccggagcgctcctatgtcaacacggcatttctcacaatggcgatcggaaatggccttacgatggcgattgcaaatccttcccaggaacttctgatgaatgcggcatttgcatcggacatgcttctgaacaaggaggagagcggcatccgctatatcgggcgcatgaattatctgtccgagaagcatgagggcatggaacatgtgtgggtacctgtcgggacggcgaagggcgctgccgtgaaaggtactgccgcgggacaggcgggaaacgcaggcggcgcaaaggattccgggaacgcgaatgaggcgcgcagtgcggtttttacggcggtcttaaagggcaataagaatcatattttagacgaggtcaaacatgcgttagacaccggggagaagccggatgacatcatcaacggacatctgatcccggcgatcaacgaggtcggcgagctgttcgacaagcagaagtattttctgccgcagctgatttcttctgcgaatacgatgaaggtggcgatcgaatatttagagccgatgttagcacgctcggacaaggagccgaaggcaacgctcgtcgtggcgaccgtggagggtgatatccatgacatcgggaagaatcttgtggtgctgatgctgaaaaattacgggtatcatgtgattgatctgggaaaagatgtcccggcagatctgattgtagataccgcgatgaaggaaaatgccagggtgatagggctctccgcgctgatgacgacgacgatgatgcgcatgaaggacgtggtggagcttgtcaaagagcgcggatgtacggcgaaggttgtcatcggaggtgcggcgatcacggaaagctttgcggaggagatcggagcagacggctattccaaggatgcggcggaatgtgtgaagctggtggatcgtctgttggaggaagagtagaaggcgaaaagcggtcttttccgccttcaaactgccccgggaaaatagatgcaaaaaaatagaaaaaaagtgttgactttttgcaatacggatagtatactaatcaagtcggttgcggtagcgaccgatgaatatgggatcttagctcagctgggagagcatctgccttacaagcagagggtcataggttcgagccctataggtcccatagatatcaatataatatggcggaatagctcagttggctagagcacacggttcatacccgtggtgtcgagagttcaaatctcccttccgctactagagagtcctcgggaatacaagcagttgtgtgtccggggatttttgttctttcataggaaaaggcttgaaagtgagggtatcatgagagtaggaatgggttacgacgtgcataaactggttgagggcagagatctgatcatcggcggtgtcaagatcccgcatacgcttggtctgctcggacattcggatgcggatgtgctgcttcatgcgattatggatgcgcttttgggcgcggcgggattaggcgacattggaaagcattttccggacactgatccgcagtataagggaatttccagtatgaagctgctctcccatgtggcggagctgatccgggagaggggttacgtggtggagaacattgatgcgacgatcattgcgcagaagccgaagatgcgcccgcatatcccgcagatggaggaaaacatcgcgggagcgctcggcatcagtacggatcaggtcaatgtcaaggcgaccacggaggagggacttggcttcaccggaacggaggaagggatttcctcacaggcgatctgcgcgctttccagtttttatgagggaagttttactgtggcggactctgcggcaggctgcgcgggctgcggcggctgcggacgaagcgtacaatgagctaagaagaattcaggcggctgcagacgaaacatgcagtgaaaaaagattgacaaaaacacaggaagtgcataaactatagtaggcaggagaggtatcttctgccgataaaaagatgaattggaaaagcgaagatcggaaagagtaaggattcggacattcgtcagagagagactgtcaccggctgaaagcagtcttggaagagagagtccccaagtgcctccgtgagctgatccggcgagagtcatctgcaccgcaggatgtagggatgccgtagccgggtacgtctggcatacgttacatgcgtcaagtgaaatcatatgattttagtagagtggaaccgcggatcatttcgtctctaggagacggatgatccttttttttgtaataggaaactttgttctggtttgtatgtggaaaggaatgggaagagatgggtatcctaaggtatatgaaggaagagtttcaggtaatcaaggaacgcgatccggcgatcaaaagtccgatggaagttttgctttatccgacatttcatgttatgctaagctacagaagggcgcataagctttatctcaaagggcattatttctgggcgcggtttatttcgcagcgcgcagccaggaaaacaggcattgagatccatccgggagcgacgatcggcaagggattttttatcgatcacggaagcggcgtcatcatcggcgagacgtcgatcatcggagataacgtgacgctgtatcagggcgtgacacttggcggtaccggcaaggagaccggaaagcgtcatccgacgatcgggaacaatgtcatgatcagtgccggggcgaagattatcggttcttttacggtcggggataattccaagatcggcgccggaagcgtcgtcatcgaggaagtgccgccgaactgcaccgtggtcggagtgccgggacgcgttgtaaagcgcgacaatatcaggacaccgcaggatgacatggatcaggtgcatcttccggaccctgtgaaggaggatatcaccgtgctgcagcatgagaatgccgaactggtgaaccgtgtgctggatctggaaaaagaagtgcgtattttaagcacgggagccggagcgtcacaggaataataagaataaaaagaaacggagaataccaaagtggagaataagttcaaattttacaatacactgacaagaaatatcgatacggtgattccgcatgaggatggaaagattgccatgtatacctgtggaccgacggtatatcattacgcgcatatcggcaatctgcgcagctacatcatggaggacgtgctggaaaaagcactgcgttatgtgggctacgatgtaaagcgtgtcatgaatatcacggacgtgggacacctttcctccgatgcggataccggtgaggataagatgttaaaaggtgcgaagcgcgagcacaagacggtgatggagattgcgaagttttacacggacgcgtttttcgatgactgcaaaaagttaaatatcaagcgtccggacgttgtggagccggcaaccaactgcatcccggagtttattcacatgatcgaggtgctgctggagaagggctacgcttatgtggcaggcggaaatgtctattttgacacttccaggctggacgactattatgttttttcttcccagagcgagaaagaactgttagtcggtgtgcgcgacgatgtggaggaggacgtcaataagcggaacaaaaatgatttcgttctgtggtttacaaagtccaaattcgaggatcaggcgctcaaatgggatagtccgtggggcgtgggatacccgggatggcatatcgagtgctcctgcatcagcatcaagcatctgggtgaatatatggatatccactgcggcggcgtggacaatatttttccgcatcacaccaacgagatcgcacagtccgagagctatctgggacacaagtggtgcggttactggtttcatgtgaaccacctgaacgacaagtcgggcaagatgagcaagtcgaagggggatttccttacggtgtcgcttctgcaggaaaaaggatacgatccgatcgtgtaccgtatgttctgcctgcagtcccactacagaaagccgcttgagttttcctacgaggtgctggacaacatgagcgttgcctacaagaagcttgtgaagagaatcgcggatctgaaggcggacggcacagtggatgagggtaaatttgcagagtacaaggaaaaattctgtgatgccatttccaatgacctgaacacttccatggcgattacaatcgtctatgacctgctcaaggatgataccttaaacgatgcaaccaagcgtgcgctggcggaggattttgacggcgtgctctccttgaacctgacgacggcgaaggtggagaatccggcggaagacacagaggtggatgcagagcttgaggcatatattttagagaagattgaggagcgcaaagctgccaagaaagagaaggattttgcaaaggcggacgcgatccgggatgatcttctggcaaaaggaattgtgttaaaggacacacgcgagggtgtgatctggcataaagcgtgagtcggagaggaagctggtatgggaagaggaatcgattcttatattaaggaacagttcgggattgcggaagtcgatatccgcacctactcaccgctgacactggcttatatcggtgacgggatctatgatctcgtcatccgttctgttgtcgtgggaaaagggaataccagagcgggagaactgcacaaacggaccagccagattgtcaaggcgcacacgcaggccgagatgatggaggtgcttctgccgcttctgacagaggaggaagcggacatttaccggcgcggcagaaatgccaagtcgccgacgatggcaaagaatgcgacgatgtccgactaccgcaaggccaccgggtttgagacgctgatgggatggctgtacttgcaggatgagtttgagcgtctggtggaactggtgaagaccggtgtggacgggctgcatttgaagttatagaacgtctgccgcgggaagaggaatcagagggcgaaagcatagagcgtctgccggtggcagaggatgctgcaggcagcagaaagcgcctgccggaagcagaaagaaaaggagaatacatgggatacgaggaattaaaaatagagggacgcaatgcggtgcttgaggcgtttcgttccggcaagacaatcgacaagctttttgtgctggacggatgtcaggacggaccggtgcgcacgatcgtaagagaagcaaaaaagcacgataccattatccattttgtggaaaaagagcgtctggatcagctctcggagacgaagaagcaccagggcgtgatcgcggtggcggcagcatatgaatatgcggaagtggatgacattctggagatcgcaagagaaaagggagagccgccgttcctttttctgctggataatattgaggacccgcacaatctcggggcgatcatccgtaccgcgaatctctgcggagcacacggggtcattattccaaagcgcagggcggtgggactgaccgcgactgtggcaaagacgtccgccggcgcgctgaactatacgccggttgccaaggtgacgaatctcacggcgacgatcaaggagttaaaggagcagggcatctggtttgtctgcgcggatatgggcggcacgcagatgtatgacctggatctgaagggaccgatcggtcttgtaatcggaagcgagggtgagggtgtcagcaagctggtgcgcgaaaactgtgattatgtggcttccattccgatgaagggtgacattgattctctgaatgcttccgtagcagccggtgtgcttgcctatgagatcgtcagacagcggatgatgtaagatgacagagcaggcataggcggacagatttttatgctgcggaaaatacagccgtgcgcggaacgtttgggcggcatagcagggcagagagggaagacggaggaagacgtggacgaatatcagaagctggcggatgaagaactcatccagaaactgcgcgaaggcgacgagcggatcatggattatatcctggaaaagtacaagccgttggtgcttcgcaaggcaaatgcgatgtttttgattggcggagatacggatgacctgattcaggaggggatgatcggactgtttaaggcaatccgggattaccggtccgacagggagacatcctttttccattttgcggaattgtgcatcaacagacagctctacagtgcggtggaggcatccaaccggaaaaaacatgtacctctgaatacttacgtgtccttttattcccagaccacggaggaagggaaatctctggcggagacgcttctcaccgaccagatggacgatccggaacagctggtgattgagcaggagaattttaccgctttctgggagcagctgcgggaacagttaagcgcgctcgagcgccaggttttagacgcatatctggaaggaaaaaattaccgccagatagcggaggaactcggaaaaagtcccaagacaatcgacaatgcgctctcgcgtatcaagggaaagatccggcagagatagagggaaggcaaaaaatggcattttgcaaaaaagagcgggaaatgaacaaccggttgtgcaaaattttgcggaaataaaaatactagtcctaaggtactgtacaaaatgtatagaaatggaacagaagttttgtgaagtttgtgcacacttctttgcgcagtcatggtactataataaccgtaaaaaccccccaatacattatatatagtttttgctataccccatagtaaaaataccttctcctaaaagggcagccagtgatggctgttctttttttgttatggaaaagagcagttctgaggaaagggagattgacagaagcatagaattgagataaggtgttagaggaaaaagaatatatcgcagagggactgtgcgcatgcgtaaacggttgagaaggttaaaacctgactcttggaacctgtcagttaatactgtcgtagggagcgaatgatggatcagatagtttgtggaatccggcgtcactgcgacgccggattttttcgtacaccctctgcagaaatggagcagaaaaatatggaacagtatgcaacacagatggaagcagcacgcaagggaattgtgacagaggagttaaagaaggttgcggcgaaggagcgcatgaccacagaggagctgatgccgctcgttgcggagggaaaggtggtcatctgcgcgaacaggcatcacaaatgcattgacccggagggtgtcggctcgatgctgcggacgaagatcaatgtaaatctcggaatctccagagactgtaaggattatgacgtggagatggaaaaagtgatggcggcagttgacatgggagcgcatgcgatcatggatctctcctcgcacgggaacaccattccgtttcggagaaaactgacggcggaatgtccggctatgatcggaaccgtgccggtatatgattctgtaattcactatcagagggatcttgcgacactgaccgcaaaggattttattgatgtggtacgcctgcatgccgaggatggcgtggattttgtgacgctgcactgcggaatcacgcgcaagacgatcgagcagatcaggaagcacaagagaaaaatgaatattgtatccagaggcggttcgctggtgtttgcgtggatgtgtatgaccggagaggagaatccgttttacgagtattacgatgagattcttgagatctgccgggagcatgatgtgacgatctctctgggcgatgcctgcagaccgggctgtctggcggatgcgtccgatgtgtgtcagattgaggaactggtgcggctgggcgagcttacaaagcgcgcctgggcaagagatgtgcaggtcatggtagagggaccggggcacatgccgatggatcagattgcagcgaatatgaagattcagcagacgatctgcatgggagcaccgttttatgtactgggaccgcttgtaacggacattgccccggggtacgaccatatcacttccgcgatcggaggagcgatcgccgcgcagaatggagctgcatttttgtgctatgtgacaccggcggagcatctggcgcttccgaatgtggaggatgtcaagcagggtatcattgcatcgaaaattgcggcgcatgcggcagacattgccaagggcgtgcggggtgcaagagagattgacgacaagatggcagacgcacgccgtgtgctggactgggatgcacagtgggaatgtgcgattgatcccgagaccgcaaaacaaatccgcgaggaccgcaaaccggagcacgaggacacctgttccatgtgcggaaaattctgtgcggtgcgcagcatgaacaaggcgcttgcgggtgagtacatcgatattttataaaacagaacacgggaaagtgaagaagcgtcagcggaaaaacaacattgcagtataaaagcggaatgtggtataataaaaaaggattctgtcagcaggagaatgaatgggaaaaatttatttggttgacagtgagaatgtaggagatatatgggtgccgcttctggtatcctcgcaggaagatgacgaggttcttgtattttatacgacaaagagcccgcatatgaattacgaaaatgtgaggatgctcaaggagacggaaaaggaagcagactttattaagtgttttgagggaagcaatgcgctggatttccagctggtatcggaacttggctatcgcctgagccagaacgcggacagggagtatgttattgtatcaaatgatacgggatttgacgctgcggtgcgctactggtcaacacggaaaatgcctgtgagccgtttaagcggaaaggaatgccacagaatgctgacagagaaaaagcagcgcgtggcaaaggaatccggggcagcagtagagccggaacaggaacagaccagagcggctggcccggaagtggaagcagagcaggttcgggagactgaacaggaagcggaagcagagcaggttcgggagactggacaggaagcggaagcagagcaggttcgggagactggacaggaagcggaagcagagcgtggcagagagcagtcaaagaagccacggtcatccaagaagtcagaaccgtcgaaagccggcggtaaggcaggagaatccgggaagccggaagcgtccgggaaggctggaaatgcagagacatccgggaaggcagaagtgatcgggaaagctgaggatgcagagaaatccgggaaggctgaaccgacagaaaaagctgggttggcaggagaatccgggaagccggaagtgatcgggaaggctgaggatgcagagacatccgggaaggctgaagtgaccggaaaggctgaggatgcggagacatccgggaagccggaagtgaccgggaaggctgaggatgcagagacatccgagaagtcggaatcggcagaaaaagctgggttggcagagaaatccgggaaggctgagccggcagagaagactggcagggcaaaacggtcaagaaagtcagcgaaagcagtcaaagcagaaaagtctgagcgtatgtcagaaccggatcgttcggaaaagtcacagaagagtgacaaagcaaagacgcagaacgcagggaatgagaagccggatctgacggaggaacaatccggacagatgacagaaatgatggatttgaaagaagaaatgtcagagaatccacagagtgtgtcaaatgccacggaccagagtgaagcgccagtgaagtttggactggatctgaatgcagagagagcaattttaaagacattgtgtgcctgcatcagcaaggaaaatctggtggattttcacaatgcgctggttgcgcttctcggcgaggaagaaggcaagcggctgtatcaggaactgaagacgaatgcagagtatgcgtcttactggtcagaacttccggcttatggcttaaaagaaaagtttgacatgtactgcaaaatggtttttgaccacagtgaatatgcaaaggaaccgccggaagatttttcgggattcctctatcaggcaaacggaaagcgaaagaatctcaattctctccgcgcagcattgcaggggcactatggcaaagacaagggaatgaaatattattccctgttcaagtcacacattaagatgatgaatcgcatgtagtaaaggagaagttgacagaatctgggtattcaacaggaatacgcaaaacgcctcaccggatggtgaggcgttttgtacgtttatcattttataaaaagaaggagaagcaggtaagatgtgggggacttaccggccatattatgaaaaagaaattgtgtcaatggggatttcctcttgacaatgattaagataccggataaatgtgaaaaaggtatgaagcagtgttgaaaaatgtgtgaagaatcgtcaaacaaattggaatccggggctgatagaagggaaaggcgaagttccagagcagaaaaagtgcgtgccagacccggaaagaatggaaaaaggttgacataatgccagaagggaagagcaacccgggtctgagacgagaaaaagtgcgaaccagacccgcatagaagcaaaaattgggtcccagaatagaaaaagtatcgctgagacccgcaggacgagaaaagtttttctacttcccccttggacacgagatagcattaacgcctcaaccgtatattccccctcatccagacttccatcacaatacatttgtcataataccgtaacactgtaacaccatagcacaaaaaagcgcaaaccctttcattcaaggatttgcgcttcttctcaatgaagctgctgacgggaatcggacccgtgacctccgcactaccaatgcgacgctctaccgactgagccacagcagcatctgtgtgagttgcctcagcacttgtactactatacactacgaagtggcagttgtcaagataataattctaaataattctttagaaatttttcgggtatttctgcggggaattttgcggcagatcaggtaaaatgtaatcaatgcacggggaggcgtgtgattctgcggcggatgtgttatgatagcagaaaagagaacaagagcaggagcggaaaaatggaacaatataacattttaattgttgaggatgataaagaaatcagggacggaattgaaatctttttaaagagtcagaattacaacgtattcaaggcggcagacggcgtggaaggacttgaggtgatggagcgggagaagatctcgctggcgatcgtcgacatcatgatgccgcgcatggacggcgttacaatgaccatgaagctgcgggaaaaatatgactttccggtcattatgctctcggcgaagtcagaggagaccgacaaggtgatcgggttaaatatcggggcggatgattatgtgaccaagccgtttacaccgttggaactgatggcgcgcgtcaattcccagctccgccggtatacgcagtttgcaaacaggagtccgaaggaggaaaagaatgatcggattcatgtgatcggaggactggaactgaatgaggacaccgtggaggtgtttgtggatggaaaaccggtgaagatgacgccgattgagttcaagatacttgcgctcttaatccggacaccggggcgtgtatattcggcggacgagatctatgagcgcgtgtggaatgaaaaggcgatcaataccgatacgattatggtgcatgtgagaaatatccgggacaagattgagatcaacccgaaagatccaaaatacttaaaggtggtgtggggtgttggatataaaattgaaaaacaacaatagaaacaacggtgccggcaataacaatgtcagcgcaaataacgatgccagcagcaacagtggtgccagcagaaataatggtgccggcaacagcagcaacaacagcaatgccgtaaacagcagcaagcggattatcatagcgatcgcgggaatcattttcatcacgatcattaccatgtgttttttcccggtggtgtaccggacggctgagagacagaaagagcagcagaaagcggagatgatgcgcgagtcctcggacagcgtggacaacgatacggtacagacactctatcagggcagctatgtcctgtatgtagaacagatggagcggagcgggcaggcagatgcaggcggactgtttttgaatctgccgacggatgatgaagattaccagtatgtaaaggacacggtaacctctacgtttgacgaatggaaaagccagtttgagagtgacagctggaacatcgattactgtgtatacaaaagcagtgccgactgcgtgaaaaatacggatcagccgctcgagacatgcgtggatggaactgtgacggagaagataaagcagtattatacggacatcgtatgcttatcctttgacaaagagggcgcgctggaagtgacaccgctgtacgacgaaaatatcagcggcagcgttctgatcaaggcgtttcagaatgtagaccgggaaaatcttttgggacagtcgctgggcggatatgtggaagcagggcagctgcagggaccgaaggactttaaggtgatcttcgggcttccggtatcaacgagtgatacgatttccttgggagatccgtatgaggatatgacaaattactgggtgcaggtggtgttagtgtaccgtgcgtccggcggaagcattctgtttctggtaagccttgctgcggtggcgggatggatgtttcttatgacgagcaggcgcatctggaacgaagacataccaatgcaacgcccggggaaatggtatctcatggaggtggcggtgattgccgtctgctgcatggcatgtatggaggaaaacttctacgatatcataagaagctattcctattatagcgaaggagtggatgttttacttggaaacaatgcctggagagccatcttacagcttggacagatgatggtcccgctcctgtttttgtatggcatctggtacgcggcgcttcgcgtactgcgtccggtatttttcctgggagtcagggaatatatcagacagtacagcctgatttatcagatttttccgtggttgaaaaaattgtggaacacgttccgctatgaggtggcgcatgtggatttttcagaaaaatccacaaagacgatctggaaaatcgtgctgatcaactttgcggtgctgtcgctctgctcgatgatgtggtttttcggcatcggcgcgctgatcgtgtactccatctttgtgttctgttttatcaaaaaatattatgacaggatcggcagagattatcaggcgctgctgcgcagtgtaagccggatggcggacggagatctggacacggagatcaccgaggatctgggaatatatgagccgatgaaggtggagctttccagggtgcgcgacggatttaagaaggcggtggatgaggaagtgaagagccagcgaatgaaaacggatctcatcacgaacgtttcccatgatttaaaaacaccgctcacggcgatcacaacctacgtggaactgttaaagaaggaggacatcacggaggaggagcgcaggtcatacattgagacgctcgataaaaagagccagcggttaaaaatattgatcgaggatctttttgaggtcagcaaggcgaccagcaacaatattgtgctgcatccgatggaagtcgatgtggtgaatctgttaaagcaggttgcggtggagcatacggagcgctttgcggcgatggggcttgtgctgcgatgggatgtgccggaggaaaaagtgatcgtggtgcttgacaatcagaagacattccgcatctttgaaaatctgtttgtcaatatccagaaatatgcgatgccgcagagccgtgtgtacgtgcaggtacaggaatacgggatggcaccggaggagttcgtggagattacgatcaaaaatatgtcggcaacggaactgaattttgatccggaggagatcacggagcgcttcgtgcgcggcgatacctcacgcggtactgagggctcaggattggggcttgccatcgccagaagttttaccgaggcgcagggcggaaaactgacgatcgaggtggacggtgacttattcaaggttgtaatcagactgaaatgtggtacactacaggtagaaaaagagatggaggtttaagacacatggaatcaatggatgattacaaggaggagttagaagcttctttccgcagaatcagagagggagatattttaaccggcacggtgatcgatgtcaacgaggagggcgttacgcttgacctgaaatattatgcaccgggatttatcagtgcggaggagatgagcagcgatccggatttctcactggcggaggctgtgcatgtgggggatacgatcgaggcgaccgtgatccgggtagacgacggcgcaggcaacattcttctctcacgcagggaagccaatgaagagcaggcatgggagaagctcaaagagatgatggaggagggtacaacggtaaccgtccgcatcaaggagagcgtgaaggcaggcgttgtggcatatcttgaggggatccgcgcgttcattccggcatcccagatcacatccgcttatgtggaggatacggagagctgggtaggaaaagagattccggtccgggtcatcacggtggatgaggagcgcgaaaagctcgtgctttccggaaaggcggtcgcactcgaggcagaggcggaggagcgcaatcacaagatctctatgatcgtgccgggaaccgtgcttgagggaactgtcgagagcctgatgccgtacggcgcatttattgatctgggcaacggactgagcggactggtacacatctcacagatctgtgagcgcagaatcggaaagccgtccgaagtgcttaaggtcggagagaaagtcaaggcaaaggtattgaataccaacgacaataagatcagcctgtccatgaaggcgctggcagaggagatggtagataccgaaggcgtggaagatctggaggcatatacagaccacacatccacaggaaccagccttggctcgcttctggcaggattgaagttagactgatcaaactatttgagaatctttctctaatagaaaactgattccgttgcttttgcaaccgaaacggctcttgcaatgtgatacatttagttagaatattctaactatgcgtaagaggcaatttcggaggaaagcaatgagaaaagcaggacttggaatcgacatcggaaatggaagtatttccatcgttgttgtcgaaggcgaaaacatcatatataaagattacagactgcatcgcggagaactgtatcagaatcttgtggacatgcttgggcaggtggagacatcgtgcggcgacaggattttgtatgcagcggtcaatcccggtgcagtctgtttgtatccggggatccaaaagaaagtgcagatcaaccgcatcagcagccttctggaaggacagagaatgctctatccggacgcgggaagcatcgtagagatgggagcacagaattcctgcttccttaccggaatccgtgagagagagacgctctcctacgccatgaacggggaatgtgccgccggaacgggagcatttttcgaggatcagatgtaccggctcggacttccgctgtccgcctactcggagtatgtcagacgggcgaaaagtgtgccgcggcttgcgggacggtgcagcgtgttcgccaagacagacctgatccacagacagcaggaaggtgtgccggtggaagatattctgctcggactttcctatgccgtgatccgtaattttaaatctgcggtcgtgcggaagcttccggtacagccgccggtgcttgtgacgggaggcgttgtctataatgaaggcgtgcgcctcgccatctgtgatatcttcggattaaacgaggaagaactactttgcggggaagagggagctgtggtgtctgctgccggaatcgcagcctgtgcatgtcacgggaagctggccttcgactggaaacacccggtccgcagggaggtggcggatgaggagcaaaaaagaaaggcgctgccgcgatatgactacgagaaggaggcacttcaccggaccagaccgttacatggcggggaaaagctctggctcgggattgacgtgggatccacgagcacaaaccttgtgctgacgggggaggacggagccgtcattgacgatctgtatcttagaacgcgcggcaatcctctcggcgcggtgcagcagggaatggcacagttaaagcagaaatacggggaagcactcacgtgggaaggcattggtgtcacgggatcggggcggtactatatcgcggagaagaccggtgcaggcacggtgttggatgagatcacggcgcaggcgcgcgcggctgcccatctgtgcccggaggtggataccgtgtttgagatcggcggtcaggactccaaatacatcagtatccgggacggccaggttgtcgatttcgagatgaacaaagtgtgtgcggcgggcacgggctccttcgtcgaggaacaggcgaaccgcatggaagtatcgctggaggagatcggaaacagtgccttgaaggcaaatgtgccgatcgatctgggagagcgctgcaccgtgttgatggaatccaagattgcagcggagcttgcggcaggcacggacaaggaggatatctgtgcagggctgtgccgctcgattgtcagaaactatttaaacagggtagtcggcaataagcgcaagggagaacatatctgccttcagggcggagtcgtgcataacgagggaatcgttgcggctttctatgaagtgtttggagaacggcttcacatcacgccgttttacgatgtgaccggggcatacggagcggcgctcgcggcaaaagagcagggcggtacatcccaaaaggagagcatccggaacgaggagaattaccggaagagccagaaatggttcctggcaggctatgacggaacgctgctgccggggaaaaagactgtgggaatcccgcgtgcgctcatgatttataaatttttcccgatggcgtaccagtattttaagactctcggatttaatgtattgctgtcgccggagacggacgataagatcattgcgctcggacaggagatggcggcggaggagacctgttatccggtaaaattactgcacgggcacatggaatggcttgcgagaaaaaaggtggactacatttttatcccgtgtatccatacgatccggcatgagacttccggcgttgcgcacaattacggctgtgtctatatgcagacagcgccgcggattgtcgcaagtgtgctggggctttcggagcgcggcgtggagctgatctgcccggttctggatctggatatgggaaaaccgcagcttgcgggagcgatgatcaaagcgggtcaggaactgggatgcgacaaggcacggtgtgcggcggcgctcgcgaagggcgcggcggcgatggtgcgctgtgagaagaattctgaaaaactgggcgcgcagatcctggacgagttgaaaccggaggacaaggtgctcgttctgattacaagaaactacggcgtgtcagacccggttttaaatatgggaattcccggggaactgttaaagagagggtgcagagtgttgacactttcccatctgaaaggacatgatgtggatttgtccggtcattatccaaatttgtactggccatttgcgcagcacattctgtcgggagcgaagatcattaaggagcatccgaatctgtatgccgtctatctgacgaaccacggctgcggaccggacggcatgatctcccacctttttgcggaaattatgggggacaagccgtacctgaaaatagaggtggacgagcatcagtccaaggtgggagtgataacgagaatcgaggcgtttttaaacagcttatcccatgtagagaactgcacggagcgcgccatactgccggaggcagccgtattgtccgagcggcttcgggacgggaagaaaggcatgaaagagacgaaagaaccgcagcaggagacggtgtatctgccgccgctgtccgtgtatacagagtggatggcactttacctgaatcagaaaggaaaacgcacggcagtactgccggattacacggcgcaggatcttcatgcgggaaaagcgtacagcaccgcaaaagaatactgtacattctcggctgcggcaggacagattgcaaaccggctgcaggagacggacggggaggaaaaacagtttctggtattccagaccgagggtgcggaggcggacggaatggttccggaaatcctgcgtgcggtcttagatgcggacggaaagagggcgcatcttgtgacaccgtttctggaacagctgctttttgcggaagaagcggatatcttgtggcaggtgctcttactcggggatgcatggcactgcctagatgaggagtggcgggaaaaggtgcgtgcctctttccgggagaagaccgccgcgccggatgcctggagcagggagtggaccaaaagccttttacaggagtgggcggtatatgtgacggaggacagacagctgctgctggccggcgatccgattgtgctgcatagcgcttatctgaatcagaatatggaggaagcggtgaggaaacatgcttttgttccggtgtatatgccgctctcggaatatctgtggttccttgctgcggagtcggggcgaaagattccggagcattttacagaacagctgcatgaatttatgcagatttaccgcggcgtttacggcagctggaagcagccggacgaacgcttacaggagatccgggagaagtttccgctggttcacggagcaaacctccgctatctgtgcagcctgatggagcaggaactgccgcgtggaaaaggaatgattctggtgtcaccggaatatgccaactatgcgtcggtgatggagatgctgcgcacggggtcaaaatatccgctgctgcacgccagggcggacggaaatgaggaagcggaagaagtggagcggagagaaatctttctggggctgctggaataataaaggagacaaaaaggaattgccgcaataagaatatcgttctttggattggtaagtaatattatcagaaaaccacaccgtgggatttcagatgaaaatgcagatggaaattcggttcaaaaaatgtggcatttctaaccagccgaatgtttgcatcttcgatgatccgtgtctttccaagtttggagcactccgcgggtcatgtccgcatcccggaagacaatttataggacttttgtgtgtgtcccttatggcacctctgaacaaaacataaccgcgcgaagccgctgtttgagtcggcatctgccctatttttaatagcagatgccgacgagttcggttcgcgcggttttatattgtctgtgaagaggcgccattagggacaccagaaagtccgcccattgtctccggtgtgtcggacatgcacccgccggattgtccaaacgtggaagagacacggaatccgatgcaaacattcagccggaagaaatgctcgcatttttttccaacgaatattctatctgcatttccacatgaaatcccgaagagtgtttctgataatattacttatcactcccaagagatctatgcttatcgcggcaattccttttttaatcgaggcttacagcagctggattccgctcttttcgcatgcctgcatcatctcatccggccacagggaggactgcacctcgccgatgtgcgccttgcgcaggaaaaacatacagatacgggactgaccgataccgccgccgatggtgtaaggaagctcgccgtcgatgatcgccttctggaacggaagcttcgcgcggtcttcacagcctgcctttttaagctgggacagcagggcttttttgtccacgcggattcccatggaagaaagctcaagggcaatgtcaagtaccggatagtatacaagaatgtctgcgtttaacgcccagtcgtcgtaatccggcgcgcgtccgtcgtgcggttcgccgttttccagcgtatcgccgatctttaagatgcacacggcgcctttggtcttggtgatatagtattcgcgctccttcggcgtgttgtccgggaacatctccgcaagctcttccgtcgtgacgaaaaagatgtcgtgcggcaggatctcctcgatgtaatcgtactggatcgccatgtatttttcggtcttgcgcaggcatttgtatacggtgttcaccgtttcctttaaggtgtcgagcgtgcgctcctcctgcttgatgactttctcccaatcccactgatccacgaagatggagtggatattgtcggtgatctcatcgcgccggatggcgttcatgtcggtgtaaagaccttccccgtaagaaaagccgtattttttgagcgcgtagcgcttccatttggcaagtgactgaacaacctccgcggttctgccgttctgctccttgatgtcgaaggtgaccgggcgctccacaccgtttaagttgtcgttgagaccggacagcgggtctacaaacagaggggcggatacacgggacagattcaggcgcagtgcaagcagtccctggaaaaagtccttgaccgtcttgatcgcaatctgtgtatcatgcaaattcaattctgaatgataatcttttggaatgattaaattgtccatctggggttctcctctcttgtgtacgcaaaagcgtagacattaacctaaataattatagcacagggcagttcattttcaagaaaagatacaggtatttgaaaaataatacgtgtatacaatttgagacgaaagggcgctcggaaatggtataaacatgcgacttcagggcgggaatccgtcgatagatgttgacagtaatatgcaaaaatgagaaaatattgacaagattattatgcaattatcatagaatctggggtatcacaagagaaaaggagttgaggcacatgcaaaaggaaaaaggaatcgtatcgattaaggttaagcttttaggtgtgatcgttccggttgtcattgtcagcattctggtgctcgtactgatcgcctaccgcacgtcggcagggctgattgagagctattccgagaatctgctggagtcatcggtggagaatcaggcgtcgcagattgagagctggctggaacagaatatcggggcgttccagatagtgaagacaacgatagagaacacgaagccggacgacaaggaattacagaccatgctggattcctactataattataactcaaattatccggagggactttacatcgcggatgagaccggaaagctctggaaagcgtcggattcggcgatgagtgagtcggatccggtcaacagtgtctggtatcaggagggactgaccagagtcaatatggcgatcggatcttcctatgttaattcagaaggcgtcagtgtcatcagtgcatccggtattttaaatgacggcagcggcaagatgaaagtcatctctgcggatatgacgctcgaccgcatttccgtcattgtaaatgcgtttatcgagatgaagaatgcggaggctatcctcgtggacaaggatacggcaacgattctggcaagccgtgattcagcgaagatttccacgacgctcggcagcgacggcagcagtgcattcgagcagagtgtagcggcgaagattgcggatcgtgattacagcttttccacattggacggcaatatgaccgtgttcaaggaggtatccggaactaactggattctggtttcctatattccgaccagcattgtactggcagaccttgcgaacctcaggaatctgatgattctgatcagtgtgatctccattctgattctgtgtgtagtgattgagcgcacaacgcatgttgtgatcgcacctgtccggaagctgacgaacgtcatcaaggcgctgacggacggcgactttaccgtatcggtcaagagcagcggcaatgatgagattgcgcttatgagccgcagcgtggagcgctttatcgcatccatgaagcagatgattgcgtccatgggagacatttccggaaaactgggaacgcaggcggatgcgagcgacagtgtgtccagagagatgcagtcggcggcaaatgtccagtcccagtccatgagtgagctgaatatgacggtggatcagctgtccgtttccgtcaatgagattgcagacaacgcgaccaagcttgccggtgtggttgcagacacgaaggacgacagcgtgaatgtcggcaacaagatgcgcgagactgttgaggtatcccagaagggacgcgaggatatggagcatgtcggcgaggcgcttgagaatatccgcacctctatccagaatctggaagcggcggtaaataaagtgggtacggcatccggtgagattgttgagattgtacagctgatcggaaatattgcggaggagaccaacctcctgtccttaaacgcttccattgaggcagcgagagcgggcgaggcaggaagaggattcgcagtcgtcgcttctgagatcggaacgcttgcaagcaacagtaccgcatcggtagagcatatttcaaagctcatccatgaggtcaatgaacttgtggcggatgcagtgcgtcaggcaggcgacagcgccgacaatatcaatgagagcagtggattgattcatacggcaattgatacctttgataggatttatgacaacattcagcagacaagcgctctgatcgaccagatggttgacaagatcaatcaggtagatgaagtggcgaccaacgtggcggcaatttcggaggagcaggcggcaagctcagatgagattcttgcaacatcagagtccatgctgacgcaggcaaagggaattgcagagaacagtgagaacgtggcaaaagaatccagaagcctgacagagtcatccatacagctggcagatcaggttaagctgtttcgcatttaaggggggtatcagatatgaagagattgatgagtgcagcactcgtggctgcgctgggagtgacgtgcctcggaggctgccaggcgggcagcacaggaggagataccgcggtgaatggcaagggagtgaagatctatgtatcactgtcacaggcagatgcgttccgtaatacattgatcgatgcggcaaagaagacagcggaggcgagtggagcagagatcgtggtgtacgatgcggagaactccatcgagaaccaggtagcgcagattaaacaggcggttgcggaagattatgatgcgatcatgtgtggaccggtcgatgcggacactgcgctggaactggaagcgctggcgggagatattccgattgtattttacaacagctgtccggatgcatcggtgctggaaccggacaaatacatttatgtaggatcggatgagggagttgccggacaataccaggcagaatatattctggatcagatgagtgacaaggatgagatcaatgtggtactcttaaagggaccgaagaatcattccgcaaccaagggaagatccgaggagttcaaaaatacgcttaaggcatccggcaagaagatcaacgtcgtgtttgaggataacgcagactgggagcagggaattgcagaagattatttcgatctgttcctgcagacaggcaagcagtttgatgcggtggtatgcaacaatgataccatggcgcttggagtcatcgattcctgcaagaagaatggcatatcgggagtaccggttcttggaattgacgcgacagcagatggctgtgcggcaatccaggcgggggatatggcatttaccgtataccagtcgggaagcggacagggtgaggcggctgtcaaggcggcaatcgcactcggttccggaggaacgacgcagggaatggaaggcctgtcggacgacggactttacgtctgggtaccgttcgagaaggtggacagttccaatgtggcagattatcagtaatagagagggaagagggcatcagtgcggtctgcactgatgccgttttggtgtaagagaatggaatatacgcatgtgacacatacgtttggacctgtttatgacgatgcatcccggattctgattctgggatcctttccgtctgtaaagtcgagagaacagcagttttattacggtcatccgcagaaccgtttctggaaagtgctggcagcggtctttgaggatacgctgccggagacgattccgcagaaaaaggcgtttttgttagagcaccatattgcgctgtgggatgtcattgcctcctgtgacattgcaggatcatcggacagttcgatccgcaatgtgacggcgaatgacatggaagtgatcttaaagacggcggacatccggcgcatctgtgccaacggggatacggcgtaccgcctgttttctaaatattgtctgaccgcggagatgccggaagtaaaaaagctgccgtctacgagtcctgccaatgccgcatggaatttagagcggctgacacagtgttgggcgcaggaacttttgctgtaagaaaaagagagggaaaaggaggtgtgagacatatgaaaaagaacgagatgacatggcaggtgatgctcattgaggcagtcggtatcgtatcggcgatcgcctatctcgggttacagatctattacgggatcgcgttccacgtcaatccggtgaacctgatgatgaatcttgtgtttatgattctggtatatgtgggtctgaccctccttgccgtctacccggaacgtgtgaacggattgacaagggaggtatgcagcggtaagatcagacagtatacgcttcggatggttcggatggtcaagcttgtctttgtggagggacttttattcaccagcgtctgtgatgcgctcgggaaagaattaaaacagggatacagcctgattatcgtggtattgattgcagcgattgcggtgtattatgagggaaggatcatacacattctgaagcagaataacaaaagatagaaaggcatctgcaatgacaaaggatatgacggaaggagcgataccgcctcttctggtaggttttacaattccacttgttctcggaaatctgtttcagcttttctacaatgcggtcgacagtatgattgtcggaaaatttgtgggggagacggcgcttgccgcggtcggtacgagcagtccgctgatgacgcttgcgattctgtttatcagtggcatgtgcatgggagcaggcgttctgatgggaatgcactacggcgcaaaggattatgatgtcctggagcggcagatcagttcgaccatgatcggcgggctgatgttttccgtcctgctttcagccgtctgcgtttttctgacgccgtggctgcttcggctgataaggacgcaggaggaagtgcttccgattgctacggggtacctccgcattattttctgcggactgatctttacgtttatttacaacttttatgcgagcacattgcgggcacttggcgacagcagatcgccgctttattttctgatgatcagcgctgcactcaatgtggcgggagacctgtttttcgtggtggtgctaggctggggcagcaacggatgtgccttttcgacggtgctaagcgaggcactctgctgtctgctgtgcgggctatatattaagaaaaaggtaaagattctctgcctggggcgcaagtggcgcgtgtttgaccggaggttattttataagacggtgcagtttggctgggtgagcgccatgcagcaggcgacggtacagctcggcaagatcggaatccaggcgattgtcaatacaatgggaatctctgtcatggcggcgtttgcagtcgtaaaccgcattgatgattttgcctacactccggagcagaatatcgcccatgcgatgaccgcgctgctggcacagaacaaaggtgccggcaaaaaggagcggatccgggagggattccgttgcgggctgtggatcgagatgatctatgcgctctttatctgtgtggtctgctttgtgtttgcgcgtccgctgatgaagctgtttgtgacggatgaggaggtgatctccctgggagtgatctatctgcatgcgattgcggtgatgtattttctgccggcggccacaaacgggattcagggatattttcgcggaatgggcgacctcaaggtgacgctcagcagcagttttatcaacatgggagtgcgggtggcggcagccattccgctggtattttccatgaaacttggaattgtggcactgccggttgcctacctgatcggatggctggcaatgctggcggcggagacaccattgcttttccgccggaaagagtgagcgggaggcggttgctttttcctgctttacaaagaaaaatgataatgatagaatacccataggtgttttttgttcggaagacacaaagggaggaagcgtttatggcaaacctgtttcagcttttactggcgcagattcaccccagacaaggaagacctgcaggagagccggaacgggcggagggatataagacacacccgaagcgcgagagcaataataaggttcgggagaccagggttttagagaccggggagagcacgcaggaacgggaaaggatacagacagaagtggaaaaggaagatttcttattaagtcagatcgacgagtttcgtgagaaggcgaaacagctgcaggatctgcttgcagcgaaggagaataaagtacaggaactgcagtcgattgtcaacgagcgggaaggcaaggccgaggagtggcagcacattctggtggagcgccaggaggaagctgacaagatcgtgacagagttcacgaagaaggtcgatgatctggcagaccgtgtgacagcgaagatgaccgagattgagacaagcatctcggggcaggttgcggaggtaaagcgtgcgagcgaggagcagcttgcatcgaaccgcaagctgaatgaggatcagattgctgcaaataaaaagctttccgaggagcagcttgcgacaaacaagcagtttttggaggagcaggcaatcgcgaacaagaagctttccgagggacagatcgccgaggtcaaggcgctgcttgagaatgcgacagcacagctggaatccatcaagacagatctctccgagaaggtacattcggagaacgtgaagtgctaccgcaacattcaggatctgttcaacgaatttgattccaagatcgaaaagatggacgagatggagcagggagtcggatcggtgaagggatatgtcaaatgtctttcctggtttgcaattctgaactttgttgttctgatcggattcatcctgtattctctcggtgtgtttaatttttagctttaaggaatagaagatcatatgagtacagaatcaaagaaagtgtgggtcgtggggcataagaatccggatacggattcgatatgcgccgcgatttcttatgcatatctgaaaaaccagagcggggacaagaagacttatgtggcaaagcgtgcgggcgcggtgaatgaggagacccgctacgtgttagagcgctttggcgtggaggaaccgccgcttgtgacctatgccggtgcacagatcaaggatatcaatatccgcaagacggccggtgtcagcaatcagatttcgctgaaacgggcatgggagctgatgaaaaagctggaggttgtaacgcttccggtcaccaatcagttcggcaagctggaaggtgtgatcgtcaccaaggatattgcgacgtcctacatggacgtgctggacaactgcgtgctctcaaaagcgcgcacacagtacaagacgattgcggagacgatcgacggtgaggtctacgccgggaatgagcatgcacattttgtgcgcggaaaagttgtgattgcaacctccaacccggaatacatggcggattatatcgaggatgacgatctggtgatcctaggcgaccgcgaggaggcgcagatgcaggcgatccggtcgaacgcgagctgcatcatcatcggcggaggtctcgaggtggcggaagaagtcaaaaagcttgcggagaagcgggactgcgtgattatcacaacgccgttcgacacattttccgtggcgcgtctgatcaatcagagtatgccgatcaagcagtacatgaccagacgggagctcgtcacgtttgacattgacgattatgtggacgacgtcaaggatgtcatgtcgcgggtgcgccacagagatttcccggtgctcggctcaaacggcaactacgtcggaatgatttccagacgtaacctcatgaatatgcagaaaaaacagatcattcttgtcgaccacaacgagaagtcacaggcggtggacggaatcggagaggcggagatcttagagatcatcgaccatcacagactgggaagcttagagaccgtatcgccggtttatttccggaatcagccgctcggctgtacctcgacaattatctatcagatgtatcaggaacagagggtggagattccgaaagagatcgcgggacttttgctctcggcgatcatttccgacacgctgatgtttcgctcaccgacctgcacgccgcttgacaagagcgttgcaaagcggctcgcagagattgcggatgtggatattgaggatcatgcgaagaaaatgttccgcgccggaagtgatttcaagaacaagacgaccgaagagattttctatcaggattttaagattttccacacggaagactgtgatttcggtgttgcccagatcagcgccatgagcggagaggaattagaacagatcggagaacagctccgcccgttcctgccgcaggtgctcggcgagaagcgtttaaatatggtatatgtcatgctgacggatattttggaggaatcttccaagattatatttgcgggggaggatgccggaaaaattctggcgcatgcgttcaagaagcaggaggatgcggatggcatcctgttggacggcattatctcacgtaagaaacagatgatacctacactcatgaatgagatgtcagagcgagtatagcccgctctgtgagcatagcccgctctgtgaacatagcccgctctgcgggcatggcttaaaggctttggcggtaatccctcggggattccccaaagctttttttgtatgctctcgagaaggtcgagtaattctgaaagccgcaggaatagcatacttccgtgatcggcgtgccggcggcgatcagctctttggcgagaaacagccgcttggtgagcagatagccgccgatggtgtagccggtctgcgccttgaacgtgtgcatcaggtaggagcggcttaagtaaaagcgggaggccaggtcatcgatcgagagatcctcggtcagatgagcgtttagataggtgagaatcgagagaatcttctcgttggaagcggagtctcccacgaattcaatgtggtggtgcagggcggcgcggttgagctgaatcataaattccaggaataaaagccggtggtgcagcgccgccgcatagtcgtcgtcgtttaaggaggcgtccagcgcgcggatggaggcgccgagcctgccgcccttggaatcctgcagacggaggatgtgtgcctgctcgcggtacgcctgcttaaagcagaaggagagatcgcagtcttccccggcgtactccgtaagaaaatccggggagacatataaaatgatgcgctcgtagggaagatccgagtggatctcgggtttgtgcacttccccggcattgaccaggacaatatcgcccggggcaagctggtaggtgcgcccctcaatacagtaggtcacgtcaccgccgagaagaatcaggatcttgtgaaaatcgtgatagtggtagtgaaactcccggcgggaagtatcttttaaatgaaacatcttaaagctggtggttaagtatccgacctttttgtattccggcatcgcgtgcgtcctcctttttctattactgtattataaaaaagcactttttgcaatataaaaagcactttgagactatatattataaaaagtgttttgtataatagttgtatatgaagaaacgcatgtccaaacagatggaggaaaataatatgaaaaatttcagtaattataccgattttgatacaaaggaaaatctgcactttgagtccaaggccgtgcacggcgcgctgggaacggaaccgctcaccggagcagtcagcatgccgatcttccaggcagcgacattccgccatccggagcttggcgagtcgaccggctttgcatatagccgtctcgagaatccgaccagacaggaattagagcgcacgatggcaattcttgagggcggaatcaagggattcgcattttccagcggacaggcggcaaacatggctgtcttttccctgttgaatccgggcgagcacgtcattttatcggatgatatttatggcggaaccttccgcattattggggacgtttttggaaaatacggtattgagcatacctatgtagacatgtcggatctggatgaggtgaaggcggcgatccggccgaatacgaagatgtttttcattgagacaccgacgaacccgatgatgaaggtggcggacatccacgcagtctctgagatcgcaaagagcgtgaatgcactcacggtggtggataacacgtttctgactccgtatttccagaagccgctcacgcttggcgcggatattgtcacacacagctccacaaaatatctgggaggacacaacgacaccatctctggcattgtggtaataaaagacaacgaggagatcgccgatcagatccatattcatatgaagtcccacggaagtcagctcgcgccgctggacagctggctggtgctgcgcggaatcaagacgctggcagtccgcatggatcgtcacaatgaaaatgcgatgaaggttgccgagtggctccgcacacagccgaaggtgaaaaaagtctactatgtcggctttgcggatcacaaggattatgaggtgacgagaaagcagaccacgggattcggcggtatgatttccttcaccgtggatagttttgagacagtgaagaagatcttaaagggcgtagacatgattatgttcgcggagagtctcggcggaacggagactctcatcacatatccgacgacacagacacatgaggacacgccggcagacatcaaggagaagctcggtatcaccgactgcttccttcgcatgtcagtgggaattgagaacgtagaggatatcattgccgatctggatcgcgcaatgaacggctgataaaggagattggtgagaagatgcgatttacaaagatgcaggcatttggcaatgactatgtgtatattgatgcgattcatcaggaattaaagaatctgccggagttggcgcggtttgtcagtgaccgtcattttgcaatcggttcggacggaatggtactgatctgtccgtccgagaaaggggacttccgtatgcggatgttcaacccggatggcacggagggggaaatgtgcggcaacgctctgcgcagcgtcggaaaatatgtatacgatcacaggttgacggacaagacagatcttgtgatcgagacacttggcggaatgcagcatctgaccctcaccgtgaccgacgggctggtatcgaatatccgcgcggacatcggtgagccgagactggtcactgcagtgattccggtagtcacggagctgcccgagttcgtggagcagccggtgcaggtgcttgaccggacattccatatcacggcggtatcctggggaaatccgcactgtgctatgtatgtggattctgtggcagatctggatgtggaaggctatggaaagacgattgaacatatgacatccatttttccgaataagacgaacgtgacgttcgtggaatttgtgcggaaggattatattaagatccgcgagtgggagagaggaaccggcgagacgatcggatgcgggacaggctgtgcgacggcggttgtggcaggcgtcctcaccggacggacagaccggaaagtgacggtcgagcagatcggcggaccgcttttcatcgagtgggatgagaagacgaatcatctgttcatgacgggaccttcccacacggtattcgagtcggaaatcgacgcgtcacacatcatcggataagaggcgcagataagcagcagtgcataagatgcgcgattgtggcgcaggaatggagataaaatgaagttaagtgaactttgcagtgaattcaaatacgagtgtctctcgggaagcatggatgtcgatgtgcgggatgtcatctatgattcccggaagattacagagggaacggtgtttgtctgcatggtgggagctgtgacggacggacataaatacatcccggatgcggtgaaaaagggtgcgtcggcgatcgttgtcgagcgtgccgatgaggcgcagcagattccggatcaaatcacggtcattcaagtggaatcagccagacgtgcgcttgcctacatgtcggcggcgttgttcggacatccggaccgtaagctggtcacgatcggcattacaggtacaaaaggaaagacgacgacgacttacatgatcaagagcgtgcttgagatggcggggaagaaggtcggactgatcggaacgatcggcgcgatgatcggtgatgagcacatcccatcgaaaaatacgacgccggagtcctatgaacttcaccggatgtttgcggctatggtggaagccggatgcgagtatgtggttatggaggtgtcctcgcagggattgaaactggaccgcacggcgggcatcttgtttgattacggcgtatttaccaacctttccccggatcacatcggaccggcggagcatgagtcgttcgaggagtatctgtactgcaagagtcttctgttccggcagtgccgtgtcggcatcgtcaatgcggatgatcctcactgggaggagattttaaagggacacacctgtcaggtgcgcacattttccgcagagggaaatgatgtgaaagaccaggtggtggatctgtttgcgtcggacatcggttatatcaacgagggcggcagactcggcatgcattttaccgtgagcggctgcatggactgcaaggtaaaagtgcatattccgggcaggttttctgtgtacaatgcgatggtgacgatgctggtgtgcaaccttgtcggtattccggaccgggcagtgctcgacggacttgagaaggttcaggtcaaagggcgtgtggagatccttccggtttcgaaggattattcgatgattatcgattatgcgcacaatgaggtgagcacgagaagcgttttgacgacactcttagagtaccatccgaagcgcctgatctgtgtctatggaggcggtggcaaccgctccaagttaagacgctacgatatgggcgaggtgaccggagaacttgcagatctgtgcgttctgacctgcgataatccgcgcgatgaggaaatccgcgacatcaatgccgacatcaaggtcggtctggcaaaaagcaacggaaaatacatcgagattgacgaccgcaaggaggcgatcgcctactgcatgacgcatgcaaagccgggggatatgatcgtgctgctcggcaaggggcatgaggattatcaggagatcaagggtgtaaaatatcattttgacgagcgcgaagccgtagcggaaatcctggacgagatcaagtcgggagagcgcacggtcgaagcgtagaataacatataagtatcggaccttttgcaataagtaatatgataggaagcattacatgcagatttctggtggaatgcctatgaaacattctgttcaaaaaatgcggcatttctaaccagccggtgactgcatctgtgatgatccgtgtctttccaagtttggagcactccacggagggtgtccgcaagccgcagacaattttaggacttttgtgcgtgtcccttattggcaccactgaacaaaacataaccgcgcgaagccgatgtctgaattggcatctgccatgttttcaatagcagatgccaacgagtttcggttcgcgcggttttatattgtctgtgaagtggtgccattagggacaccaggaagtccgctcattgtctgtggcttgccggacaccctccgggattgttcaaacgtggaagagacacggaatcagatgcagcccatccggctggaagaaatacacacatttttttcaacgaatgttccacatgcagttccacccgaaatcgcaggacatacttcctataatattacttagcgcgtattcttttcataaagcggttgacttccgagaagacagatgataatatagtattcatataagattactatgaaaaaagatctggagatagggtataaagggaggaactgatatgaagatttccacgaaaggacgctatgggatccgtgcgctgattgatctggcggtgaattccaccaatggtcatgtgtcgctggtaaatattgcaaacaggaatcagatttctgtgcactatctggagcatgtgttttccagcttaaagcgcggtggtattgttaagagcgtcaaaggcgcgcagggcggctacgtccttgcggataagccggaaaatattacggttgcacagatgatcctcgcgctggagggcagctacagtatcgagccggaatcggtgaacgaggatgcactctgcgagacggtgtcaaaggtgatggacacgctgttgtgggatcgcgtgaacgaggagacgaagcggatcttagagagcattacgctggcggatctggtgaatgaatttgtgcgtgagtacgagaccgagcagaatatgtattatatctaatcggaaggaaagtacacatttcttttataagtgataaagtacagtttacaagggactacacagggtaggtatctgacgggaggggtgccgccagtcagattttccatgtgatgttcaagctgtcgcttgtggcggctatggtggtgatcatcaaatccaccacacgccgcttgtcatcaaaagatacattctcccaggtatcgaggtagccggaaatctggctgacctgttccgggctgatggcctccacagtcaactccgctatccttgccagaagttcctgcttgcgcccgtccagttccgctatcttcacattcacataggagaacaggacattgtttgcccccgtcagactgtccaccagcttttcaatctcgctgtctacatgggcaagttccacttgcagggcggtgattttcgggtttgcctttgccgctttcttttttcctgtcagcgtcttgtagcttgccagcttctttaccatctgctgataaacaaccgcttccagttccgaagtgatgattttcccacagccaggacagcttttattgtccagccgtttcgtgcagcggagatactgtttgccggagggattgtagatactcataagagcatacccgcaattcccgcacttgatttttcctgccagccatgtgtgggtggctttccgggcagactggattttcatgttgttcatcagcttcttgcggcaggtcagccaggtgtcggaggggacgataccctcatggggagccagtaccagcatttggtcttttaagtcgtttttcttgctggcctttacatctcgcccttgatacagatagcagccgttcatgcccgtaaaatcggcaacgtcattgacaatgactgtaccttgacttttgaaaaattcgtacacatcaaggtctgcctgcacatagacaggattgcgtaacatctgcgccagcgtggggcgtatcagctctttgccatggaacaaaatcccctgttcggcaaagtaccgggtaatgtccccgtaggaagttgtgggctgggcgtacatctcaaacatcagccggatattggccgcttcctccgggtttaccaccagcttctttgtgttgataccgtccatcttgataggctccgtatggaagccgtaaggggctttcccgcccatcttaaagccccgctgactgcgggagtagtaagcgtccgttacccgcttctgtatcgtttcccgttcaagctgggcgaacacgatacagatattcagcatggcccgtcccatcggcgtggaggtatcaaacttttccgtagaggacacaaactccacattgtactgctggaacagctccatcatgttggcaaagtccagaatggaacggctgatacggtcgagcttgtaaaccacgacctttgcaatcaagccccgcttgatgtcccgcaccagttcttgaaacttcggacggtctgtgttcttgccgctgtaccctttgtctgtgtattccttgcagttaccgcctttcaactcgtatttgcaaaattcaatctggctttcaatggaaatgctgtcctttttgtctaccgattgtcttgcatagattgcgtctatccgattgttcatattgtcgctccttttcttaaaaaagaaacggagctgctgacagttctattataccgccagcagccccgcaaatcaatgatgggtttggaaaaccttatgtcccggcttcctcactctcccgcttgtcggcgtacttgcggaacacctcataaagctgctgttccagttcccggcgtttggctgcttcctgttccggcgtgaacaccggggagagattttccagtgtgatttcctttccctgaaaagtcacgatttcgatttcctttttgtatctgatattacttataagatcacctttcctttccatgctgccgctgttgccgtttcagttccgctaaaatctccggcgggatacggtcaaccagccgccgcatatcgtccagttcgctttttaacttcgcccgttccatcgtgtcattcatcttgcctttttcgctggcctttgccctgacttccagcttttcattttccgctaacaagtcattgattgtgaccttgtattttttcagttgcccggagaagttctccatctgcggaaaccactttttcagcatggagagggcttcctctttcttctttccggcgttcagcggggtaatgccggagagaaccgcttcaatggccctcgcctgtttggagaggttgaccgcctgtttgaacagccgggtggggatatgcttccggcccgtcttgctggcgctttccccacgctccaggtcggggtactgctccaccatacaggcgtgaaaatcgtcctgccacttcgtcagattggcccggttgccgataatttctttggcgcacaggcggttgtcctttgtcagcggcacaaagaccaagtgcagatggggcgttttttcatccatgtgtaccatagccgaaacgatgttctcccggcccacccggtcaatgaggaagtccgccgccctctggaagtaggccgctatctcctttggggacttgcccttgaaaaactccgggctggcggtaatcagcgtgtccacaaaccgagtgctgtccttgcgggtgcggcatctggcctgctcgatgcggctctgaatgaaatggtagtagcggccatccggcttgacgatgtggaaattgtacttgctccggctggtgtcaatgtccgggttgctggcgtactgctcctttttccgttcatggtgggcttccagcggccccgccgggtggcccttgtgcttctcaaatcgcaaaattgcgtgttgtgccattgaactcctttccccattccattcctttccggcgggttttcccgccgaaaatatctctgataggattggaatggaatgaatgtaaatagatggttttaatctctgtatttctatataccgtcagatttccgtacttcaagaggattgattttcgtactcgccaagtacggttttcagccctccggcgtaccataaccggatttcttgaagtcggtgtttggaaccgcttcataggatttcgggtaaatgcggttgggttttccacagccctgtttctggatttccaccagccccgcatactgcaactcccgcagggtgttgaccgctttctgccgcccgcagcggagcaaagcgaccacctcgcagatggggtagtacaggtagacccgcccgtactcgtccgcccagccgttcttccgggacaactccgcccggcgcaggacaaaggcatacagcaccttcgcttcgttgctcaagggctggaatgtgggtgcttcaaaaaggaaattggggagccgggtgaaactgaacgccttttccggctggtgaatataaatcgtgtttgtcatagcgtgttttgtggacggttagaggcccgttttccggggcgaatgataaatgataccagccgccccggttgagggcttgcggagccttgcaaatcaaggcttttcccgctcttaactgtccacagcagacctccttttccgttcactttctgttttctgccgcctgtgaactctggcggcgcagtccgggcagtatttgccccggttggacttcgggacgaacacaccgccgcactccgcacagcgtttcaagtccctgtcccggtaaatctccgcttccagcgtcctgtccagcggcaagaccgcccagcggaaccacttgcagcagacggagaacgaaatcatctgcggacaggcgcaggtgtcgccatcgtccagcgcaaggcagtttccgtcctcgcagttgcagcactcccggcgtatcaggccgctggctcgtctcttctggggcggggttatgcggtagggggagccgtccggcctgtgttccagcggcggcaggtgttgatagggtcttttgctcatgcgtccctccgttttctttggcgtgttctgtttccaaggtgcttgtccatcgatgaactatcccaagtctacacctttttgaccgcctgtgccgtatatccaagaggtaggaaatcagcctgaaaaactccctatttccacgctctcggatttgtgatataatcaaaaaaagataaaagacaaattcaggtttctggtcttcttgcacaaaataaaggaggagctattatgcaaattgtttatattccaagcgaatcaatgtctgttcaaggtaaaaaagatgaaatctataaaagatatgggaaagactggaatattagagaacagggaggaggtaacggaaattggttgttgaccagaaaaagtgatgtgcttgtagatggaaaaagttatcgtacttttgtacttgaacactacggtaaatccaagctgacagcgaagcttgttgataaatttcgtgaagatgtagcaaatggtaaaataaaactgtaaatgcctatgccgttatgctatgagcatagtacatagcataacggcttctctttcgttgagctagcaaggagggtgaatatgtctttatccatacaagagcgattaaaagacctacgtgtggagcgtggcttgacgctggggcagcttgcggagcagaccgggctttccaagtctgcgctgggcagttacgaaacggaagacttcaaggacatcagccactatgcccttatccggctggcgaagttttacggtgtgaccgctgattatctgctggggctgtctgaaatgaaaaatcacccaaacgccgatcttgcagacctgcgtttgagtgatgaaatgattgacctgctgaaaagcgggaggatagacaataccctgctgtgtgagctggcggcgcacccggatttcccccggctgatggctgaccttgaaatctatgtgaacggaacggcactgaaacaggcgcagggtgcaaacgccatagtggacacgatgagcgcaactgttataaaaaagcataatcctggcatgagtgatacgcagttaagacagcttatcaccgcccatattgatgaggacgagttttgccgctatgtgatacaacgggacataaacgggattgcccttgctctgcgggaaacacacaaggacgattttttcagcgtcccagaggataacccgctaaaagaaatgctggaaactgctggtgaaatcgtcagccaggacagcgacacggaacaagcgtacttggcgtttatctgcaaacggctcaagctgaattttaggaagctgtcagtagaagaacggaagtggctgaaaaagattgcggaaaaatccgacttgctgaagaatccaaaaccgcagagaggacgaagataaaaaatgcctgaacggcggttctggtttttcagaaccaccatccaggcattttgtttagtaatagaaaaaggtgcagttgattattgcgtattgtcaatctctctcaaaccgggtagtaaaaatacggcaagcgcaacgatgataatgccaattccgcaaatgacaaaccatttctcaactcccagccgctccgccagaggcccggaaatgacaaggccaaacggcatggcgagggaagcggcgcttgtcagtagagaaaaaactctccccagatattctggtttgaccgtttcttgaaaaatcgcattttgcacaccgtaaaatggagcggaaattcccataacagtacagcacacaacaaagacaagaaatgcgtctggcggcaaaagcccggagagcatattgctaacgcccatcaggagaacggaaagaccgatggtgtaccgccgtttcttaaaaccgccccaaatgctcagaatgactccgccaagcagcataccaaccgcaaaagcaatttcagcggcagaggcatgggccggtgttcctttgaagtatgacatacagatgagaggaaaaagcgtactgattggcatataaaagaacatataaattacaccaatccagagcagagcaaagaggcccctgttttgctttaataccacatacccctctttcatatcctgtaaaaactgttgtcttttcgtttctggacatagttcaggcgttggtatggacgaaatcgcaacagtcacacaggcaaggattgcacccacaatatctaacaatataattgcattaagaggccaaacagcatataaaaacgctgcggcagctggactgataatcgcacttactgcttgcatggtcgacgtgtaaccagcgcattttgtaagttcctcttttggcacaatcataggtgttgctgcgctgaatgctggagaatgaaaagcagttcccgcacttcggattaacaggacaaccataatagaccatacgggcaattccatgtaaaacgccaccagcgccagaataccgccagcggcggcaattatcaaatccgcaccaatcattacgcttttacggctgtgccggtcaacaaaagcacctgcaaacgggcctaaacaggcttgcggcaaaaatccaatcagtgttgccgccgtcaatatgattgcagaattagttttcgcaaccaaataaaagataatggccatttgcaaaataccgctgctaataaaggatattgcttgtccggcaagaagtgtaaaataagtttttctccatgaattgttgttttgggtcataatgcgaacctccttttttattgcattgttcctttgtttctgcaataaaaagcaggcgttgtcccacagagagggcagacgcctgcataacaacaaagcacgaaaaaacaccacgatacagttcaaagactgctcgtgtcaaacctacgtgttcctttgcatacgcacgcaaaaaaagcccaccatcatgtggaaaggtacttctactttttattgcttattagcgtacacaaattaacacacgtaagcctccttccaatctcaaactgtcgcacagtataacacacatccgatagacttgtcaaccatttttaaccttgttttccatcttgtttttccatctcttacgggcagtagcaaagccaggcgagccagtcaacggtcaagatgaacggcgctttcagcgccgccgttgacagtctcgcccgtctttgctaatgggtaatcaaggcgggaaagccattttagggctttcccgcccatttcaattttgggagaagaaaggccccaaaatgaacgagtgcggccaaacacttttagggattggccaccttgtccacccatccagcggggcggcggggaacggtcaaggccgggcgtcagcccattcatttcagccttgacggtttcctgccgtcctgctacttttcccggagtgtggccacacatctggtcacggtgtccagagctttgggactttttgtcccataggccgggggcggaggacgagggacgggggctttcataatacgccctgtctgctgctgaaatcagccctttgtttccggcttaccagccccaaacaaagccctgctttcctgccgcgtcaaatgcccttgccctccccggcggcaacggtattttcagggcaacgccgacagagcgtataacacactacactttgctccgcaaagtcgtgtgccaaatggggcgctgccccctttggaaacccccgcaacaaacaggtgctatgcacccagccgggagcatagcgccgtttgttgtcagcagcccgtttcacggtctgcgtgtagttccttgtaaactgacctaagtaatattataagaaacacacttgaggatttcatgtggaaatgcaactgggaattcgttggagaaaaatgtgagcatttcttccgacggaatgtttgcatctgattccgtgtctcttccacgtttggacaatccgacggggcatgtccgacacaccggagacaatgggcggactttctggcagcactaactgcactccctcgtagacatgataaaaccgcgcgaacagaaactcgttgccacctgctattgaaattaaggcaggtgacaactcagacatctgcttcgcgcggttatgttttactgcaacataaggatggctgatttatgccatccgttgtttggtgctggtaagtgctgcacgaaagtcctacaaattgtcttccgggatgcggacatgacccgcggagtgctccaaacttggaaagacacggatcatcgaagatgcaaacatccggctggttagaaatgccacattttttgatccgaatttccacctgcatttccatctgaaatcccgcggtgtgatcttctaataatattacttatctttttaaaagaaaatggtacaatcagtcgccgtccggctttactcagggtcagatccgatgcagcttctgctcatatttttcctgacgaaccggaagacggaacggattgttgacatagacgatcatgtacatgccggctgctgtaatcatacctgtcacaacgtcgaagacggagtgctgttttaaaaacatggttgagagaatgatgctcaccatgaggatggcggaaccgcagcgcattgcgtgtttgtgcttgaacgcatcggaacgccataccgcaatattgaccgcaatcgagttgtatacatgaatgcttggaaacaggttcgtcgcggtgtcggaagcgtacagccacttgacgatatgtacaaaaatattatcccgcgcaaaggttgtcggtcttaggtaatgtccgttcggataaatggtggacacaatcaggaaaattgtcattccggtaaacagcattgcgcacagccggaaatattcggaacggtcttttaaatagaaataaccgatgccccagccgacgtagccgaaccataacaggtaggggatgataaaatattcacagaacggaatgtaatcatccagcgcggtgtgaatgacatgaaaatgtgtggtgacggtcttctcgagatgaccaaaccatggaagatagattgcaaaataagataaaagaaacagagccttgtttcgatcaataaagccactgattctctgacgaagttctggtttcataatatccatcctttctataataaatagcagtatatccaatttcttcacgtttgcgattatagcacacgcatttctgcgagacaatcggctttctttttttttaagaaagattatttaaaatttaagaaaacgttcatacatcgaaagatcgtttgtgcatttatacaataagaaataaaacgaagattttacataattgttacgattgggggaagttgttgacaaacaaaaagggtcatttataataaaccatgtgttttcactgaaagaacaggcatataaatgtttacgataagaggaaaggaaacagaaaatgaaaaagaaaatcgggattaccgcggcagtcattctgggaatactcgcagtctgctatatcggattcgcggtgtttttccagagccacttctgctttggcactacgatagatggcattaaagtgggaggatgcagcaccgtaaaggtggagcagctcatagaggaggagatcggaggatatgagctgactctggtggaacgcgaggatcagacggagaccatcacggcatcacagatcggcgcggcgccggttttccacggggagatagaagaactgctggcggatcagaacgccttcgcatggccggtgattctgtttggaaagagtgcactggaactggaaaaaacggttgcctttgacgacacaaagttttccgggacgatcgaagcgctttcctgcatgcaggaggagaatcagagaaagccggtggatgcgtcctgttccggctattccgcagcggacggctatacgcttgtcccggcggattacggaacgacgatcgatgagacagcgttgaaaaacgcggtggcagaagccgtggaagggctggaggacacactcgacctggagaagaacggctgttatgtggacccggcggtgggagacgacgacaaagatcttctcgccgtgatcgacgaattaaaccagtacgttgcatcgacggtcacctacgatttcggggatcagacagaagttgtggacggcagtacgatcagcgagtggctttcggttctggacggtgaactggaggttgacgaggaggcggtgctcgactatgtcaagggacttgccaagacttataataccgcgtacaaaccgaagacgttaaagacttcttacggaccggaagtgacgatttcaaacggcgcttacggctggaagattgacacggagggagaggtggcacagctgcttgaggacatcaagtccggcaagagtgtggagcgagagccggtctattcccagacggcgaacagccatggcgagaatgactacggcaattcctacgtggagatcaacctgacatcgcagcatctgtttgtatacaagaacggaagtctggttgtggacagcgattttgtatcgggaaatctgtcaaagggacacggttctccgaccggagcgttcagcgtgacctatacgaccacggatgccgtgctgcgcggagaggactacgcgacgccggtaaaatactggatgccgtttgcgggagacgtcggcatgcatgacgcgagctggagaaaaagcttcggcgggaatatttataagacaaacggatcgcacggatgcatcaatctgccgacatccgtggcaaagacgatctacaatacgatcgagaagggctggccggtactggtgtacacgcttccgggaacagagagcgccgcacagctgcagcaggatgtgcagaccgtgattgatctgatcaattccatcggtgaggtaacggcggacagtgagacagtcatcgcgtcagcgcgcagccagtatgatgctctgccggattctacaaaggcgaatgtgacaaattacgatgtgctcgtggcagccgaggcatcactggcacagatcaaagcggcgggagagcagacgggaatgtagtctgtctgccgcatggaattgtcgcaataagcatagacctcttttgggtgataagtaatattatcagaagatcacaccgcgggatttcagatggaaatgcaggtggaaattcggatcaaaaaatatggcatttctaaccagccggatgtttgcatcttcgatgatccgtgtctttccaagtttggagcactccgcgggtcatgtccgcatcccggagacaatttgtaggactttcgtgcagcacttacctgcacttccgcagtaaaacataaccgcgcgaagcagatgtctgagttgtcacctgccttaatttcaatagcaggtggcaacgagtttctgttcgcgcggttttatcatgtctacgagggagtgcagttagtgctgccagaaagtccgcccattgtctccggtgtgtcggacatgccccgtcggattgtccaaacgtggaagagacacggaatcagatgcaaacatttcgtcggaagaaatgctcacatttttctccaacgaattcccagttgcatttccacatgaaatcctcaagtgtgtttcttataatattacttatcaacgcaaagcatgatatgcttattgtgacagttttttgtttcatggaaaattatgtaataaaggagagacgaaatgatacaggatattttaccactgcatctgcagaatcagtacgaaaaaaaacagccggacgataccagctatatgatgatctacagggagaacaagatccttgtaagggagggagagacgcttgccttccttacttaccgggaactccgggagatctgtgagacggcgggagaaatggcgccgcagagcatctatctgttttccgttggggaggagacgtattttctgacggaactgccggagcatctcacaccggaaggatactgttttgaaaaaatgtttgcggtgcggtcgggaaagccgaaggagcacatccttgcggctgccacggcatggcatctgtacgagtggtatcgggataaccggttctgcggaagatgcggacagaaactcatgcacaacggaacgctgcggatgttattctgtcccgcatgcggcaaccaggtgttcccaaagatcgcaccggcggtgattgtcggggtgacggacggagagtatattctgatgacaacctacgccaacagggagtacaaacggtacgcgctcatcgctggatttacggagatcggggagacggcggaggagacggtcatgcgggaagtgcaggaggaagtcggtcttaaggtgaagaatatccactattataagagccagccgtggggatttgaccagaaccttcttcttggttatttctgtgaactggacggagagcgggatattgtgctggacacgggagagcttgcgacagcggagtgggtgcattattcggatgtgccggaagatccagaggggctgtcgctgaccagagagatgatgtctgtattccagaaaaattttacgtctgagaaaatgtcttgacagtcaaatgaacatactgtattattacaatagtacaaagaaactttaaaaaaatggtaggatttcctaagaattcttaagttttacttaaacccattttttttgaggggtgataatgatacaatcaccataaatttgtaaaatacaggtaagggagagacgagaatgaaagacaagaagcaaaaaaacgagcagaatgcaggcgcgatagcagcaaagccaaagaagaaaaagaaggtactgatcgttgtgctggttattgtggcagttctggtggtctggatcggtatatccatacataacgcgaccaagcaggtggcgatggcggtgaataccgtggaagtggagccggtacagaagagggatctgtccgatacgatttcggttaagggaacggttgccggagccagcagcacgaatgtgacgtcaaaggcggcgtccgagatcacttccatgaatgtgcaggtcggcgatatcgtgaaagagggtgacgtcttatgcacactggactccacgtcgatcgaggagaagatcgcagacttagagaagtccatgtcgaatgcgaatgcggtgagcagcatcaatacacagcaggcggcggacgccctgcagcaggcgaaggatgaccagacaacgacgcttgcggcggcgcagaagacactcgaccgcgcaaaggacagctacaacggcgcacagatgctctacgatcagggacaggcggatttcgctgcactgctcgctgccaagcaggcggtggaggatgcgcagactgcttatgatacggcagtagagaccaccaaccgtgcgattgagacagcacaggaggcacaggagctgaacaagtacaaagacaccgacacgacatccaaggacacactcagcaatctgaaagaacagctggcggactgcgagatcacagcgccgtgcggcggtgtggtaacagcggtgaattccaaggtcggagacatcaatgcagagaagaacgtcatcatgacgattgaggatacgagttccttaaagatggttgcaaccgtgcaggaggcggatgtattaaagcttcaggaaggcatggaggcaactgtgaccgcagatgcgacgggtgatgagcagatcaagggaaccgtgaccagagtggtccgtgtgaagagtcagggcacgacgggaagcgacggcagcacgacttctgccggtggttattccattgagatcgcgctcgacaatcaggaacttttaatcggaatggctgtgaaggcaaaagtcatgatccaggcaaagggagaagtgctggcagttccgtatgatctgatccagtatgatgacaacgggcaggcgtatgttcttgtggctgaggcggacgatggcggaaacgcaaccgcagtgcgcaggaatatcacggtcggcgatgaggtggattattatacagaagtgaccggcggtgatctcgcagagggagatatgctgatctacgacacgacattttcgatagccgagggacagacatttacaccggagcagatgtattctgaacaggatatgggactgacagacggtacaggtacggaggttagcgaatagtgagtgaaccagtaatccgaatggaaaaaattgtaaagacatattatgtaggtaagcccaatgaactggaaatcctgcacggaatcgatcttaccgtgaaccagggagagttcgtttccatcgtcggtgagtcgggttccggaaaaagtacattgatgaatatcattggagtattggatagacagacctccggcagctattatctggaaggacaggacgtcaacggcatgacggacgaggtgcggagtgcggtccgcaaccgcagaatcggctttgtgtttcagaactttaatctgctgccgagagccaatgcattgaaaaatgtcatggtgccgcttatatatggtgaggaaaagacgaagaatgcgaaggagcgtgcgatggagatgctggcgatggtgggaatggacgggcgtgcagatcacagaccaaatgagctctccggcggacagaaacagcgtgtggcgatcgcccgcgcgatgatcaatgatcctgcaatcattctggcggatgagccgaccggagcgctggattccaagaccggacatatggtcatggatctgtttcatcggttacatgaagagcaggggaaaacgattgtactcatcacacactcccaggagcttgcgacggagacacagcgtattgttaccctcttagacggtgagatcgtgggggacaacaggggaggtgagcactgatgttttttgaaaacataaaagaggcaatcatcagtattctgtcgaacaagatgcgttcactgctcacgatgctcggtattattatcggtatcagttccgttatcatcatcacgacgatcggcggttccatacagagcaccctgaccgcgacaatgaattccctcggcggcaacacagtttccggctatgtggaggcgcgctatccggaggacgatgcagactgggatacctggatttatccggatatgacacagagtgattatgtgtcacaggagatgatcgatgaactggttgcgcagtatccggatgaaattcagggtatcgctgccgagaattatcttggaggcgggcagatcaaggatgaggcggattccgacaattatgccaatgtcagtgtggatggcatgacaccagaacagttcgagtatatgaagcttgagatgcaggcgggacgtaatcttaccagggcagacaatctggggaagaaaagagtctgcgttgttgcggatacgatggcaaagaattattttggagacaaagacccgattggcgagacggtatcggtaacaatggacgacggatcgatctatgattttgttgttgtaggtgtttacaaatacaatgcggcactgtttggaaaagtggatacatctgtcagagaaaaggatcgttccacttatatgatgattccgatccagaccagcttcaagctgcagggggcagataagactggttatgaatactttaatctgctcctgacgccccttgcggatgtcaaccaggcaacggaagatatccagaattattttgatgaggtatatcagaacaatacgaatttccatgtgacagcgagcaacatgcagtccagcatgggcatgatcaacacggtgctcaatgtcatcacgattgcagtatccggaatcgcagcaatctcgctgatcgtcggcggtgtcggtgtcatgaatatcatgcttgtgtcgatcacggagcggacgagggagatcggtgtgcgtatggcactcggcgcaaagcggcggacgatccgtatgcagtttgtcattgaggcgatcatgctctgcttaatcggcggcattatcggtattctgatcggtgttggtgtcggagcactgctcggccaggcagcgaagtttgtgattgccaatatgtattccgagtattccaattacattattatgcaggtgcatccatcggcaactgcaattttactgtcactgttcttctcgatgctgacaggagtgttcttcggttattatccggcgaacaaggcgtcaaagatggaagttatcgatgcactccgctacgaataggcgtgtgcagccaaagatgacagaaaaaggggcagagaagctttaccgcttctctgcccctttgctgtcattttgcgtgaaaaaattgaaatctgctgtcaataaatgtataatgataatataaagggaaaatgatcgaaggggagaatgagtttatgacggatgttttgttctatcagaattatacttatgtagccgatatcagcgcgattgtgctctgcatcatctgctggctgctgttgcattcttcctatacggtaagagagaagagcctgattatcttcaaagcgggaacggtttgcctgatgatggcgacggtctgcagtatcagtttccatacagcaatcacacggattacagaatcccggaagattcttatttatgtgttacaggatgggatatatcttttactgattctcacgtttgtgctgctctgcaattacttcggtacacttcttaagctggaagagagaccggcaagactcttgggcgcggtatcctggggcggctatgcggtgtttgcttttcttgagatcggatcaccgtttacgcatctgggtttttatatcgatgcagatctgatggttcatcagaatttctattttgatccgtttcgttttgcctatatttattactgtatcgttcttgtcgttgtgctttttacgtaccggaagaagttcgtgctgaaaatgctgcgctgccttgcctatattttactgttttcgtttggcatgattgcactggaggcagaatatgtatctacatcttatagctgcatggcactattacttccctatatgggagtgctgtttttgtttcattatacatcttacgacagggagacaggaacacttgatgctggtgcgtttgacagctatctgagagatgtgggggacgatgatttttctgtaatcttcatgggattcccggaaaccaatctcaaaaagataccagaacttccgcgtacgattctgacgtttgcggagaattatttcaaaacattctgcctgttccgtctgcaggatgataagcttgcactggtgtatcagagactgagtaataaagcggagaaaaacggaaaatataacatacaaaaaacgtttgagcgtgtgtgtaaagaacatggactgggctaccgggtgctgattgcacatgcagatgacaggctgcgtgaggcaggtgagtatctggcgttgaatgagtttatggaagagaaaataccggttggcgcggtatatgagtgtcagaataaggacatcatagaatatcggaaggcatcttacatattaggcgaattaaaggacatcaatgcacactgcgacttggaggatgagcgcgttaaagtgtactgccagccggtgctaaatacacgtaccaaccggtttgcctcggcggaggcgctgatgcggctggagctgccggaaacaggaatggtatatccggatcagttcataccgatggcagagcggcacgattatattcatacgctcagcaaaatcatcttaaataaaacctgccgccagatcaaacgcctggagcaggaggggtatcagatcgaccgtgtttccgttaatttttctattctggaattccgcagaaaggaattctgcaaggatgtcatggacatcatccgccagaatgaaatcccgtatgaaaaagttgcgattgaactgacggagagctggaatgagacggaatttgacaacattaagaatacgattaccagtcttcagaagctgggaatcaaattctatctggatgactttggaacgggctactcgaatttcgagcgcattatcggtctgccgatcgatgtgatcaagttcgaccgttcgctgactattttggcagggaaaaatgcagaatcccgctatatggttggaagcttttccgatattttcaagaattcgcactatgagattctgtttgagggtgtggagaacgaaaaagacgaggatcagtgcaagcagatgaatgcactgtacctgcagggctacaagtattccaaaccgataccgatcgaggaactgacacgcttcctggggcgggcggtgtagaatacatccggcgtgcaaaaacccctcagcgcatctcgggggtacggaagaggaaagccgggacaggttaagaacagaatgataaaatgttccgggtggaacttgccggcagcagttctgatcacaaaatccggcatttctaatccacaccgcgcctggcatccccgatgatccatgtctttccaagctttgaacactccacggatgtgtccgcaacctgcagacaattttaggattctcgtgtgcctcttatggcactgctgaaaaaaacataaccgcgcgaagccgatgtttgaattgccatctgccctgtttttaatagcagatggcaacgagtttcggttcgcgcggttttatattgtctgtgaagcagtgccattagaggcactagggaatccgctcattgtctgcggtttgccggacacatccgtggattgtcaaagcgtggcaaagacacggaatccgatgccaggcgcgatgcggaagaaatgctcagattttgctccaaagaaccgccgccggcaagttccacccggaacattttaccattctgtttttacctgtccctgcttttctccgccgtgtccccgggatacaccgggtttttaggcatctatgattcgacgaccgccagcccccagggagccagtgtcaggacggcaccggcggcaaccggggtgtcggttaaaagatcggtgcccgcatttccggtgtggatcactgtccgcggttctcccgaatagttgaagtagtagcacagatttttgccaaaatcgtttgtgccgcgctttacgatcagcggaaactgcggtgtgtcttcggaaagaccttcatacccgtgtctggagaggtaggatacgagcagcggctccaacagttcatcatcgaagaaagcgccgaggtagagggcggagcccttctgataggcgttctcggtcacggcggcataactgccccagaatggatggtcataatgcgcgagcggcgtcgcggtgtcacaggtgacaagctccatccagtcgtgtgtgagggcgctcctgccgtctgtggtggcgatgcggacattcttcgggtaggtgaactggtcgtagtgaatgccaaggcacctaccaagaagatgtggctgtacgtcgtggtggattttcaactgttcgtcggcgaagccggtgcggaaagtggcgatcaggtgtccgccttctgccacgtagcggtcgagcgcgccgaggagatcgtcggatgcggcatagagcgccggaacaacgagaaaatcataggcggaaaaatcgcgctcgccggaagagaccatgtcaaactcgatgtttctgcggtacagggcgtcggcaagccagcgcatcacggcattgtagctgtggtcaccggtggtctcaagcggaaactggcgcagccccgccagggagagattgtccagcaggatggcgacgcggttttcctttttcagattcatgaggtgtgtgccgatgcgcttccactccgcgccgatttcgctggcttcccggtaggtggcattttcggaaaaatcgtgggaaagcacgcctttccagtagctttcgatcgcattgtggatcgagtgccagtgccagtacatcacgctgttggagccatttgcaaggtggctgtacgcctgcaggcgcagctgccccggataggggagccacggggtcagaccctgcgcctctgtctctaagatcagataattgtccttctttaagctgcgcgcaatatttccgcatacagtgatctcagctccggtcaggtcgtcctgcgaaggatggtaaatatcggcgcctgctacggtcatgcagcgggcggcgtcatactggtcgacctccggctgatagccgtaagagtgatcggtccagtcaaaatcaaaattctgcgtgatgaactggtcgtcacgtttgtactctttgataatgtccgattgccaggagaggaactctgtgacgagggagcgctgaaaacgctgaaattctgcggcaagactctggttgatcgtgccgcgtacatccggaaaatccgcccagtcgttcacgcggttgctccagtaatccagaccgaattcacggttgaaatccaaaatgtccgggtattttttcttcagggaagcgacgaacatctgctgaacccgcggacctgccgtcccgtagctcttggtctcgttgtccagctggaagccgatgatgttcggaacgtcctttaagtgctccatcatggcgcggatgatgcgctcggcgtgataacggtagccggggtgcgtgatgtccatgttctgacggtgaccgtagagctcctgcccgttcgcagtgacggcgagaatatccgggtatttgcgcaccagccaggtcggaatcgcgtaagtcggggttccgatgatgacggaaagatgatgctttgcggcggtctgtatcatgcggtcgatgcaggtaaagtcaaagacgccgtcggacggctctaaggtgctccaggtggactcggcgatgcggatggtattcatgccggcacgctccatcatttccatatctgtctccagacggttatacggcaaatattccagatagtaggctgctccaaagagcaggtgatctgttctcatatcgggtgatctccaatcttttctaaaattttctataagaagtagttgttttgcacatgctggcacaaaaaacgtgcaaccgcttgcgctttttcattatatcatcgcaaaaatgaactgtaaacaacagaaagtaccgtaaatactgcaaaatatgagagcacatttttggtaaaaaagtggattgatttttctggaattgtgtttgataataaaaaaagattgcgcaaccagcgcaaaattaagggaactccggacgatagtccagagttggaggttactatggagaaggaagagaaaaaagatattaccattgcggacgtagcggaggcgttaggggtttcaaagacaacggtttcacgcgcaatatccggaaagggaagaatcgggaaagagacccgcaagagggtcatggaatacatagaggagcacgattataagccgaacgctatcgccaagggattggcacagtcgaaaacgtacaatatctgtgtggtaatgccgcgcgattatgaagtggtggactggaatttcttccagcgctgcctgttcggcattcaggagatggcggagaccgtcggatacgacattctgcttacgatgtgtcagatgaatgacatttcctcactggagcggattgttgcaaatcataaggtggacggtgtgattctgatgcgtacctttctggaggatgcacagattgaattcctgcagcagaaaaatattccgtttgtgacgacaggaagtacgaattatgagggtgtaatccagatcgaccacaaccacagaagtgcctgccgggaattgacatccattattttaatgaagaatttaaagcggattgcactgatcggcgaggacgagggatacatggtaacgcacagccgtctgctcggattccgggacgcctatgaacagcagggggagacgctcgatgagaatctgctgtatttaagcccggaaaaccgggtgcgcgtcgatcggacggtaaaggagatcctggaacagaatgtggactgcattctgtgcatggacgatgcggtgaccagcagggttttaaaggtactgcgggaacagcacgtcagggtgccgcaggatgtgcgggtggcatctttttatgacagcacgattctcgagaaccatgtgccgtcgatcacttcgcttgctttcgatgccaaggaacttggaaaagtggcgtgccggacgcttttagatcttgtggagggactggaggtaaagcagaagacattacttccatatgaggtcgtactcaaggaatccacgaaatagtgcacaccgggcagtgcggattgtgtcggaatacggtgtctgacacgccggaaatggtgcagggaatgggaaaatcagcaaaatcgctcaatatgcgcttgaaatgttggaaaatataaagaaaacagtggaatatgcttggaatattcgggtttatcggttgcacaaaaataatgaatgattccacgaaaagctgatatttttttaaaacttgtgcatttgtgccaaaaaaaaagcaaatttattataaaatataaacattgacatcaaaacaggcacgtaatatactttaatcatagaacaaccgattgcgcaataagatgcgcagtaccgcaggtacgatacggaattgggcatgcggcgttctgaaaaagttttgaaaaagaaaagggaggattttcaaaatgaagaaaaaagttttgagcgcattattatgtgcgagcatggtagcaaccatggtagccggatgcggcggaagcagcagcgagacaacagacagcaatgcagcagcagacaacagcgcagcagacaacagcgcagcagcaggtactgaggaagcagcagctcctgcagcaagcggagacaccattgctttaagagtatgggccgctgaggaagaccagacattaaccaacgagcttattgagcagtttaaggaagcaaatccggatcagacatttgacattacagttggtgtagagtctgaggcaaatgcaaaggatgatatcttagttgatccgacagcagcagctgatgtattcgcattcgcaagtgatcagctgattgatcttgtagatgcaggtgtattacaggcagtacaggatgttgataccgtctccagtgagaacgtagcaggtgctgttgaggcagctaccgtagacggtacattatatgcttacccgatgtctgctgataacggatacttcttatattatgacagcaatgttgtaacagatccgaccaactgggatgcaatccttacagactgtgcagcagcaggcaagaaagccggaatggtgcttgcaagcggctggtacaatgcaggtttcttctacggagcaggatttacaacagtattaaatgatgacggaagcacagcaatggactggaacggaacatctgctgacggtatcaagggtaccgatgttgtagacggtatgcttgcaatcgcaacaaacccggcattcttaccaatcacagacggtgatacagcaaaccagattgcaactggtgagcttggtgctatcgtttccggtacatgggatgcagcagcagtacaggaagcattcggtgatggatatgcagcatgcgcacttccgacttatacatgcgctggcaaccaggttccgatgggttctgcagctggttacaagatgatcggtgttaatgcaaactctgcacaggttggctgggctatggaattagcaaagttcttaaccaacgagcagagccaggagacacgttttgctgagagacagatcggaccgtccaacattgcagctggcgagtctgatgaggttaaagcaaatgtagcaatcgctgcagttaccgcacagaatggtgctaacggtgttgttcagatagtaggcagcggttactgggatccgtccaaagcatttggtgagatcattgctcagggtaacccggacggaacagatgtacagacattgctggataatctggtagagtctgcatcacagccgacagaataagcagtaacacgattttataagagtgtatgaagagaaaaaggcccgcatacgaagatgggaatcgtgagtgggtctttttcttcatctgaatatcaacagaacccaaagaacacgcagaacaggtatacactgcgtgcagcaaagatacaaggagaacgccattttacagaaaatgacggttatggaaaggcatgggtgcttgcatgaatagtaaggaaggtaaaaagaatccggtggctgcattcttcggagcaatcggaaaattctttaaggaatttggtgaggctgccgccaaaggggacggtgcagtgaaagcatcgctgctcgtagcgggtgccggttattggaaaagaaaacaaatcatcaagggatttctggtaacattactggaaatcgggttaattctatatacggtattgatcggggtgccatatatcagccagctgaataccttaggtacggtagagcgtgcgatggtgtacaacccggcaacgatgaagaatgaggtcaatgattatgataactcccttctgattctgctcttcggtgtcatcagtctgagttttctcattgtgggaatcctgctttggatggcaaacgtgagaaatacataccgcttacagcttcgcgctgaagcgggaaagcacatcaatacatttaaggaagactgcaatgagatgctgaatgataagtttcattttacgttgctggcgcttccggttctgggtgtgattatctttaatatcatgccgttggtcgttatgatctgcattgcatttacgaactatgataagagtcatatgccgccaaatgcattgtttacctgggtgggacttgcaaactttaagtccctgtttaccacgagcattacctccacattcggatatacattctggagaattctgggatggacgctgctctgggcagtgcttgccacatttacgacctattttggaggaattattctcgcccttctgatcaacaacaagaacacaaaattaaaaaagatgtggagaacgctttttgttgcagctatttccgttccacagtttgtaacattgctgttgctgcgtaactttttcgcaaacacaggaattgtcaactcattctgtaagagcatcggcctggttgatctgttacagaatcttggctggatcaaagcaaattatattccgtttctgagcgatccggtctgggcgaaaatcacgatcgttgtcatcaatatatgggtaggtgttccttatctgatgctgattgcaaccggtgtacttatgaacattccggaagagttaaaagagagtgcgaagattgacggagcaaactcattccagattttccgcaagatcacaatgccgtatatgctgtttatcacaggaccatacctcgtaacacagtttacggcaaacatcaataactttaatgtaatttacctgctgacacaggatatttacacaacgaccaaccagaaactggcggcttcctggggtaaggagattgatcttctggttacctggctgtatcgtctgaccagtgagcagtacaactataagatggcatccgtcatcggtatctgcgtctttatcgtatgtgcagtcattacattatttgcctttaacttcctgattaaaggagataaggaggatacattcagatgatgggaaagagaaaaattgttaattccgttttgcttcacgtagtgcttgcagtgcttgcagtgatctggatcacgccgatcgtgtggctgattgtaacctcgttcagcggatatgacggcatgaacacgagccgcttcttcccggagacatggtcgatccgcaattatactcgtatgctctttgaaccggacacggtatcacagttcccgatctggtttaagaatacgttggttattgctatttttgtatgtctgatttcaacttcttttgtattgatggtcagctatgcaatgagttgcatgcgtttcaaaggaagaaaagctctcatgaatatcgcagttatgctgcagctgttcccgggctttttgtccatgatcgctatttactttattttgaagtccgtcaacttaaccaacagccatatcggtatgattctggtgtactccggtgcatccggactgggttaccttgtggcgaagggattctttgatacgattccgacatccctgcgtgaggctgcgtatctggagggtgcttccgaggcaagaacattcttcacgatcgtgcttccgctttccaagccgatcattgtgtacactgttatcagttctttcctggtaccgtggacagatttcgtttttgcaaagatcatcttaaactccggtatctcgacagactggaccgttgcgatcggactttacaacatgctgaatcgtactctgatcccgacatacttctcgagattctgcgcgggcggcgttatggtcggtatcccgatcggtattctgttcattatcatgcagaagttctatgtagaaggaattaccggcggttcggtgaagggataaatagcgaagggaaatactattgcaggcattgcagcattggctgcaatgtctgagtatttccaacttcgcattagaaaaatgcaaaagcggcatttttcaaagtgcaatacaagtttttaggtaggcgggtgaggatgcaccaggcatctttttcataaaaatgaaagaaatatagaaattgaggaggaagaaaatggatcaatttattttaaatctgattcacagaccagagatggttccggagtattccgcaactgtcacaggacagggaaaggaagaggacatcggagacaaggctctcttgacagaatctctggatattttcaagacacagcagagactcgcacatgagaatgggttaaaagtaaccattcagatgacatacgcatctcttttcaatgatgaggcagtggagattgcgaagcatgaccacgacgtatacggagacgagatcgcattatctctgctcggacttccgtgtgaggagttccgtgagaaatacaagaccaaggacttctgtatctggatgttctccatggaggacaaaaaagccatcgtcaacgatgtgtttgagaagttccatgacagattcggattctatccggagtcaaccggttcctattacatggatgccgatctgactaactatatcaaggcagcttatccgaccgtaaagtgtgcggttgccacctgctgggaggaaggtccgaaagcttaccatacctgcaacaactcctggtatacgttattcgacggcggcccatgggcaccgtggatcccgtccaagcagaatacacatgcaccggcagccaatgcggctgaggacagcggtatcgttgcaatcccgcatctgtcccgcgacttgatcgcatgctatgacggtaacggctccaacttcggaacgcatccgcagaatgtacttcgcggaatgatctacgatacaaagacctgggagtacccgtatctgtacaacctgatcgatcagtatcgttcgttaggaaaatacaacaacggttatgcatacaacatgatgtttgtaggaccgggctggatgaacaagatgggacgctgggagcagccgtatgagcttctctacaagtcttacagcgacggctgtgcatattacggcaagctgaaaaaagagggcaagttagtcgatatgacgatgtccgagttcgcagattactaccgcgagaagaagggcgtggatgccggcaactacaatgagccggagtgtgcgctctggagagatatcctctacggatcagacaagcagctgttctggtactgtgatccgtacatgagagcctgcgtcaatatggatcagggcggtgcaatcgtcgaccttcgtccgtatgcagcgaaactggagtggccggttggtatcggcacaaagcatgtacaggatgcctcttatccgttcctgattcaggagaagtaccgtgcaggttacttcacacattacgcaggagagggaactgtaagaagtgcgaagctttcctacaagggtgaggaagtagatctgtgtctctgcccgacacacgcacatttttcacaggagggaaagacaagaatcctgacactggatccggtaacgatcgagttcagagatctgactgtaaagcttcagacaaaagagtactttgaggaaggctcctccaacatcaagatcgagcgtaccatccttgagatgagtgacccgagtgcagaggttaccttaaacgagtatatggttgcatgctacggcacaaccgagtattccgaggatatgtcccatatcaccttaaagatcgacggaccggaagagaagacgatccattatgagtacaagtgccgcgaggagggtgtcaagggtgcgacagaagtaagcgccgtgattccggagatcgagacacgcgtatccatgactgcatccaacgcggacgcagagggatatgtaaaagagggatatgcattctcaccgatgtttaccctgggatacagaaaaacaatctcagataaggaggtatttgcaacatggctcaacttggcaaaggcaaattaaattatagatgcccgtcctgctttttaagagatctggacattgatatgttttacaataaggaaacaggtatttacagctgtatccgctgccagtacagaggaacagaagaagacgtcctggagaaaaatgagatgatccgcttccgctataaggcaatgcaccagcggttcgacaagttcgactttgattaagctacgagcagtgtagagaaatccagtgacaccggaggaaagcttgctttccagaggtgttgctggatttctctatagggcgacagcccacagcgagacggagcgaagtggaatcgagctgtcacggcgaggagcgcagagctggttgcagaagaatgcgacagcccacagcgagaagaagcgaagcggaatcgaactgtcacggcgaggagctttacgctgccacagcggggagaaaatggagtaattatggggaaaaagaagaaagataccatcgagcttcggttctatgagataccgcaaaatgaatatgttctggcacttcttggagaaaactggatccgggattatggtcatgatgaggtacatcttcattttcacaatctgatggagatcggagtgtgcagaaacggtacggggaaactgattctggacgaagaacagcgcccctatcagcctgccatggtgagtattataccgaacaactatcctcatgtgacgatcagcaatacaaaagaaggaccaagctactgggaatatctgttttttgatccggcgcagattattgcggaaatgtatccgaagaacgagctgttctgccgggaactgatccggaaagtcaaccggagagcgctgtttctccatgaatgggagaatcacaatctcgcgtttcttgtccggcagatcatggaggagatgcggggacggcgcagccattatacggacagcgtgagaggtctgttgtattctcttgtgatagagattatccggctgaatgaggagcaggaggcaaagcaggaagtgcagggtgtggaaatgcagaaacattcgggagtgacgcagattgcggcggcactcgactatgtgcgcatggaatatatgcacatgatccgggtggaggagctggcgcaggaatgtcatatgagtgagacgcatttcagaaggctgtttgagtcctgtatgaacatgtctccggtggattacatcaatcttgtccggattcagaaggcatgcgatctgttgaaaaagacgacggattcgatggacattgtggcacagaaggtaggctttacgacaacatccacatttaaccggaattttaaaaagtttttaaacacatccccctatcagtggaaaatcaatccggaaaattacgagacaaagcttttaaattacaatatttccgcgcgaaaaggatggtaataaataatggttgaaaatgcgcgttttgtgccgaaaaataagtacaaaatgcgcattttttcgctataatgaacttaacaaacgcaataacagcaatcataaattgggggatgaacagtatgggagaatttttgtttgagagattaagtgatccggaatattacgaggagaaccgcgtggcggcgcactccgaccatgtggcgtaccggaactgggatgaggcggacgtgtggctggatccgctcggaagaaagagcagtttccgcctgtttttagacggatcatggaaattccactatgcgagaaactatgagcagacgatccatggatttgaaaagccggaatacgactgcaggggatgggatgacatccgcgtgccggcacatatccagatggaaggctatgacagtccgcaatatgcgaacacgcagtatccgtgggatggaagggaagacgtctggacggacgagatgccgacgaagttcaatccggtcgcaagttatgtgaaatatttcacattgccggagtcctttttgggagagcgtgtgtttatctcgttccagggagcggagagcggcatggcactctggctgaatggagcgtatgtcggatacagtgaggattcttttacgccgtccgagtttgaactgacgccttatcttaaggacggggagaacaagctggcggtgcaggtattcaagtggacgatcggaagctggtgcgaggatcaggatttcttccggttttccggtattttccgcagcgtctatctctacatgattccaaagacgcatctctgtgacattaagatccgtccacaggtggcggagaatctgtcctgcggcacgctggagctggatcttcgctcctgcggcagcggaagtgtgcgcatacagcttgtggagcgcggaagacttgatctggcggagagccgctatgagacaccggagggcacggaggtgtttgctctggaggagaagatggaaggaaccttacatgtctcgcgggaagtggcggatgtgaagctgtggagcgcggaggagccgtatctgtatgaacttcggatggaggtgtatgacgcggcgggcgctttgcaggaggtcgtcgcgtcgaagatcggcttccgtcggttcgagatgaaggacggactgatgcttttaaacggaaagcggattgtgtttaagggcgtcaaccgccacgaattcagttccctgaccggacgtgtggtgagcatggaggagacgctcaccgacgtcgtgaccatgaagcggaacaatatcaattccatccgtacctgccattatccggacaatatcggactgtatgagctctgcgacatctacggactctacatgattgcagagaataatatggagtcgcacggaagctgggatgcggcggcgatgcgtaagattgccgatccgcggacgattgtgccgggggataatccgaagtgggaggcaagaatgctcgaccgcgtgaattcctgctatcagcgggataagaaccatccggcggtcttaatctggtcctgcggcaatgagtcctacggcggaagtgtgatttatcagatgtccgagaagttcagagagctggatcccgaccgcctggttcactacgagggagtctataacgacagacgctacaacggaagcagcgatatggaaagccagatgtacccgccggtagagcggattgtgaaaaatctggcagagcagaaagagaagccgtttatctgctgtgagtacacgcacgcgatgggcaattcctgcggcgcgatgcacaagtacacagatctgaccgacacagagccgcgctatcagggcggatttatctgggattacatcgatcagtccatcacgaaaaaggatcgctacgggaaggaattccaggcgtacggcggtgacttcttagagcggccgacggactataatttcagcggcaacggcatctgctatgcaaaggggcgcgccgagtcaccgaagatgcaggaagtaaaattcaattaccagaacatcagcgtatcctttaccgaagatggttttacggtaaaaaataaaaacctgtttaccgatacggcagagtatgactgcatccttctgctggagaagaacggcgtggcggcaggccgcagaaaaatagcgctgtctgtggcaccgctctcggaaaagacgtttgttctggaagaactggagggctgcatggctcttgccgatgaactggaacatgcgggaaaggaagccggggcggaatacgcactgaccgtatcgtttgtactgcgcggagaactgctctgggcaaagccggggcatgagatcgcattcggacagaagatttttgcggcaaaatcacctgcaaatggtgggacaatcggcgatgccgcggcagaatatgaaggaaagtgcgtgacgaaccgtaaggcgggacttcagatcatccgcggaaagtggaatctgggggtgaagggagagaattttgacgtactgttttcctacaacagctgcggactggtgtcctaccgctacatgggaaaagagctgattgagaagataccgatgccgaatttctggcgtgcgccgattgacaatgactgcggaagccgcatgcaggggcggatggcgcagtggaagatcgcgagtatgtatgccggcatgagcagcaagggcatgttcgattatgaggaaccggttgtgagagaggcggagaacagcgtctccatcacatatacctacctgcttccgaccacgccgcaggcaaaatgccgcgtgacctacaccgtgacgccggatgcgtatgtgcagaccgagctgacctatgacccggtggaggagctgggcgatatgccggagtttggaatgctttttaagctgaatgcggattacgacagactggagtggtacggacttggaccgcaggagacgtatgcggaccgcagatgcggcgcgaagctcggtgtatataagaaccgcgtggcggataatatggcgcagtatctggtaccgcaggagtgcggcaacaaagtaggcgtgcgctacgcgaaggtgacggatgcaagaggaagaggcatgctctttaccggagacgaactgtcattttccgcactgccttatacaccgcatgaactggaaaatgcaatgcatgcgtatgaactgcctgaggtacattacacggttgtccgtgtggcactggcacagatgggcatcggcggagacgacagctggggagctccggttcatccggaatatcacattgatgtgacaaagccgttagcactgcggttcggtttccgtggaatataaaaaaacagaaaggagagagcgggcatggaatgagatctgtgcccgtgaagaggcatatgaagtttgtaaaaggaatggatctgtccacactgctcgaactggagcggtgtggtgcaaagtattacgataacggggaggagcgggatctccttgcgatcatgaagagctatgacgttgataccatccgtatccgtctgtggaatgatccgtggtcggagaccggcgaatcttacggcgcaggggagaatgatttgaaaacttctcttgagattgcaaagcgtgtgacggcggcagggttcggcgtgcttctcaattttcactatagcgatttctgggcagacccgggcaaacagatcaagccgaaggcatgggcagattacggtgtgaaggagctggagcaggcggtctatgattacaccctggaatccatgcagacattcctggatgccggcgtcaatattaccatggtgcaggtgggaaatgaactttccaacggtctgctctggccggagggaaaagtcccgaactatgacaatattgcgacgttcgtcaatgcgggaattcgtgcggtgcggaaagcggatgcggcgattccggtgatgattcatctggataacggcggaaacaatgcgctgtaccgcgagtggttcgacaattttacaaagcggggggaggatttcgagattatcggactttcctattatccgttctggcacggatcactgcagatgttaaacgacaacatgaatgacattgcagagcgctacggcaaggatctggtgattgccgaggtttccatgggctatacgatggaagactacaagaattacgagaagctttccgatgaagagcgcaagggatatgcgaccagaccggcgcttgtggagaagatcgaatatccgatgacaaagcaggggcagtacgatttcatggaggatttcttgaaccgcatcagccacatcaaaggcggaaaaggaaagggattcttctactgggagccggcatggattccggtaccgggctccggctgggcaacaccggcatccttaaaatacatgaacgatccgggaccatgtggaaacgagtgggcaaatcaggcgctgtttgactacgatggcaacgcactgccgacgcttgcactgatccgtgattttaaaccggaagtataaaaaacggggctgccgcatgaacggagattgtgatcgatggcattgtgaaaaatgataaatgacagatcggaaaaacatgcaactttgttgcatgtttttttgattatgttgcagtttgaaaaaggtctattgcaaaggaacacagagacgttataatagaattacaacaggacggtaacagaaaccattcatagaaaaaatgatgtataaggaggtaacgcatgatctgggaaccagtacttgcaaagtttaaagaattatttggggatgagggagagatcggagtttatttcgcaccgggacgtgtgaatatgatcggtgagcataccgattacaacggaggacatgtatttccatgtgcgctcacgatcggtacctacggtgtggcgagaaaaagagacgacaagaagcttcgcttttattccatgaattttgagaatctcggtgtgctggagtcttccgtggagggcttaaagccggagaaggaagcagactggacgaactacccgaagggtgtgatgtgggcgttcggcgagaagggcatgaaagtggagtccggtatggatctcgtgctgttcggcaatattccgaacggttccggattgtcttcttccgcatcggtggaagtgctgaccggattcatcctgcgtgatatgttcggctttgatgtgacgaatcaggatctggcattgatcggccagtattccgagaacaagttcaacggcgtcaactgcggtattatggatcagttcgccattgcgatgggcaaggcaggacatgcgattttcctggatacggcgaccttaaagtatgagtatgcgccgatcaggctcgagaatgcgaagattgtgatctcctgcagcaacaaaaagcgcggactcggtgattccaaatacaacgagagacgcagtgagtgtgagacagcgcttgccgaactgcagaaagtggtaaagatcaacgcgctcggcgatctgacagaagcgcagtttgagcagtatcaggatgccatcacaagtccggtgtgccaaaagcgtgcaaaacatgccgtatatgagaaccagagaacgatcaaggcggtggaggcactgcagaacaacgatgtcgcgctgttcggaaagctgatgaatgactcccacgtatctttgcgtgatgattacgaggtaacgggaatcgagctggataccctggttgaggaagcatggaagatcgacggtgtgatcggttcccgcatgacgggtgcgggctttggcggatgcacggtcagcatcgtgaaggatgacgcggtggatgcgtttatcgagaaggtcggaaccgcctataagaacaagattggctatgccgcagatttctatgtcgtagagatcggcgacggcccggtaaaattggcgtagtgacagagtatatttagaaacgaggttggatcatgatacaggaaagaatattggaactgacagaatacggactggtgacgggactcatagagccgcaggataagcggtttacgatcaaccgtctgctggagctgtttcacattgacgaactggaggatgaagtcacggcggcttatgagaagcgcacgccgatgacgcaggagagcgccgaggaggcactgccacagatccttgcagagatgctcgattacgcggcggagcagatgctgattccggacaatacgattacataccgcgatctgtttgacacaaagatcatgagcatgctggttccaagaccgagcgaggtggtacgccgtttctatgatctttatgagaaggagtctccgcaggcggcgacggattatttttacaagctgtccagagacacggactatatccgcagataccgcgtgaagaaggatctgaaatggacggcggacacagagtttggaacgctggatatcacgatcaacctgtcgaagccggagaaggatccgaaggcgattgcggcggcgaagctggcaaagcagagcggctatccgaaatgccttctgtgcaaggaaaacgagggatacgcaggacgtatcaaccatccggcgagacagaaccaccgcatcattccggtgaccatcaaccagagcgactggtttttccagtattctccgtacgtttactacaacgagcactgcattgtgttcaacgcaaaccacacaccgatgaagatcgagcgcgctaccttcggaaagctgcttgatttcgtgcagcagttcccgcactattttgtcggttccaatgccgatctgccgatcgtcggaggatccatcttaagccacgatcatttccagggcggtcattatgagttcgccatggcaaaggcaccggtggagcgcgagatcacattcaaaggatatgaggatgtaaaggcaggcattgtaaaatggccgatgtctgtcatccgtatcagcgctacggacaaggatcgtctgatcgatctggcagacaagattctcctcgcatggagaggctacacggacgaggcggcattcgtctacgccgagacagacggcgagccgcacaatacgatcacaccgatcgcaagacggcgcggcgatgcgtatgagctggatctggtactgcgcaacaacattacgacagaggagcatccgctcggtgtatatcatccgcatgcaaagcttcatcatatcaagaaggagaacatcggtctgatcgaggttatgggtctggcagttcttccggcacgcttaaaggatgagatggcggatctggagcaggcgatcttggacggcgttgacatccgtgcggacgagaagctggcgaagcatgcagactgggtggaggaatttcttccaaagtacggctttaccgccggcagcggtctggagggcgagatcacaccggagaggttacatgagatcgttcagacagagatcggtctggtatttaaggaggttctcaccgacgcaggagtctacaagtgcacggaagagggcagagcagccttcatgtgctttgtggatacggtgaacgcatagaaatagagagaggaaaagaacggattacgggacggggattttttccccggaagttgtccgttctttttttcaattcccgataaatgtgttatacttgtgcatggagcaaatttttgcaaatgaccgtttactttcacgtggtaatttggtaaagtaaaggaatgagaaaacgatgcgggtcagaccgcagaaaagaggataggtattatggtatcaaagagaatacaaaaagcgctggagggcaattcggcaatccgcgccatgttcaatgagggcagggagatggctgcaaagtacggggaggagaatgtgtttgacttctcactcggcaatccggcaaccccggcgccgaaggcgttaaacgatgcgatccgtgaccttctggatgaggcggatgcaaagggagcggcaggttctctgggcattcatggttatatggcaaatgcgggctatgaggaagtacgccaggcgatcgcagagaatttgaacgaacgtttcggaacaaagtttacggcgcacaatctggtgatgacagtcggcgccgcaggcgggctcaacattattttcaagacgattcttgacccggatgatgaggttatcgtgtttgcgccgttcttcggagagtatcgccagtacgcggcgaattttgatgcaaagattgtgattgtacagccgaatctggagacgtttcagccggatcttgccgatctggagtcaaagattaccgcgcggacgaaggcgcttatcgtgaatacgccgaacaacccgaccggcgtgatctacaagccgcagacgatggagcagatcggagcgattttagagaaaaagcaggctgaatttggaaccgatatttacctgatctcggacgagccgtaccgggaactcgtgtatgacgggaataaggaggattttctgacaaaatattaccgcaataccctggtgggatattctttttccaaatccctttcccttccgggagagcgtatcggttatgtcgtggtgccggatgaagcggcggacgccgaagagctgatccgcggcattgagatctcaaaccggacgctcggatttgtcaatgcaccgtccctgattcagaaagccgtggcgcgctgccttgcggagaagacggatgttgcattttacgatgagaaccgaagcagactctacgaaggactgacaaagctcggatttacctgcattaagccggagggagcattttatctgtgggtgaagtcgccggtggaaaacgaagaagaatttgtaaacgagggaaagaaatttaatcttttaatggtaaagggaagtgctttcggctgtccggggtttgtgcgtctcgcatattgtgtgtcccatgagaccgtggaacattccctgcctgcatttgcgaagctggcggcagtgtacggactggacaagtaggaggaaaaaggatggagaactgggagtcatatgtgagaaaagtggtgccgtatgtgccgggggagcagccgcaggcggagcggatgatcaagctgaacaccaacgagaatccgtatccgcccgcgccgggggtgcagagggcccttgccggatttaacccggatacgctgcgcctgtatccggaaccgacctgtaaggtgcttgtggatgcgattgcgtcatattatggactgggcagcgatcaggtattcgtcggggtcggttcggatgatgtgctggcgatgatttttctgacattctttaattccggaaagccggttttcttcccggatattacgtattctttttatgatgtgtgggcagatatgctgcgcattccgtatgagacgaaagcgcttgatgatgcgtttgagatccgggtggaggattattacggggaaaacggcggagtgatattcccgaacccgaatgcaccgaccggcattctgatgccgcttgataagatcgaggacatcatcgcgcacaaccgcgacgtgatcgttgtggtggacgaggcgtatattgattttggaggggtgtcggcgctgccgctgattgaaaaatatgacaatcttctgatcgtgcagacattttccaaatcgcgttccatggcgggaatgcgcatcggatatgcgatgggaaatgcgaagctgatccgttatatcaatgacgtgaagtattcgtttaattcttatacgatgaaccggacagcgcttgcacttggtgtggaggcgatccgtgaccgtgcttattttgaggagaccagaaaaaagatcatcgagacgagagagtggacgaaaaaagagctgcgggcgttaggttttacgttcggggattcgatgagcaattttatctttgcttcgcacgagcgcgtgccggcaacagaactgttcgaggcgctgcgcagggagcatatctatgtgcgtcattttaccaaggaacgcatcaacaactacctgcgcatcagcatcggaacgagagaagagatggagacgtttattcggttcctgaaggaatatctgaaagaggcatagccgatgagcggccggccgcctgcagctttcggatgccggaggtaaagacgatcagaccgccgactgtcatggcgatgccgaacaggaaccagaagatcagagaaaacgtcgtgtcgccgaacgggatgagcccggagagcacggttccccagaagttaaacagcatgtgtaaaaggatcgagtaatagatgctgccgccgcggttgcagacatagcctaaaacaagccccagacagaatgcgtagatgccctggatcatgttcatgtggaagatgccaaaaagcagcgcctgcagcagattggctgcccagaaaggcagacatttttttgcctgatgcatggtgacgccgcggaagaccagctcctcgcagaacggggcgaagatgacggagcagacgaccatcagaatggagatctgatcatcgagacctgccgtctcgagcagggattcatatgcatccatccagtgcggaaagagcgccgcgacaaagctcatgatataggtcgtcagatactgtgtgcccggcatcagcatgacgatgcctgcgattgcagcgggatgaaacgtctggcgcagagcggggcggtaattgccgccgtaccggcagtagtaccacagaccgaacacggcgatcgacatggcattgtagattaacagtacgccggtgttgaagcgctgggaactccacagggaaaaggcgtcatctacaatatcgaggaaccccgcgctgccggtgacagagtaccagccgctctcgatcagcagggaaagtcccatggcaaagtaggttgcgagaaactgaatcgcaatcacaagaagcagcgggacaaaaataaacaggaattgttttaatttcttcattattataatctccagttatcgttggtatgaaataaagttcttgcaatttccagatacttctattattataacaatcggatttcatgaatgcaagcagtggaaaaagtgcgtgcatggacagaaacttgggtatttactttaaaactttaatatgctaaaataacaaaagaatccattttgggaagaaggagaagaacatgagtaagaaacttaggacagatgcagtggatcatctttttgacgccatcttgagcttacagaatagagaagagtgctacacattttttgaggatgtatgtacggtaaatgagctgctttctttatcacagcggttcgaggttgccaagatgctgcgtgaccagaagacttatctggatattgcggagaagaccggagcatcgactgctacgatcagtcgtgtcaaccgatccctgaattatggaaatgacggttatgacatggtatttagccgcatgcagaatacggacaagtagtagagacagataaaaagagccacaggagaacgggaacttttgcccgtgcctgtggctttttcgattactttttatttttttctgccttggacttgtccgaggtggtcgtgtcaatgaggcgctcgatgatggtctttttgacatagacatcgtagcttaacatgcagatcagactgaagttccgcagaagctcggcgtcctcaggggcagcatccgggaatgtctgacacgaggtgttgaacttcctggcgaggtctttcatgagattttgtgtctcctgatgctcgagtccgaagacttcacggtagatgtcttccaagctgtagctgccgtcttttccgaaatatttgtccgtgatcggatttaagatgctctggatgtcactgatgcttaggatatttttaaaatagtagatgaaaatcagcgtcagtacgtgctctttggtgtactttttcttctccggcggagggagaagattgttcttggcgtagttgttgatcatcgtcttggtcagaatcttgtcatccgcatgccgtttggatgtctctaactgggaatccataaatgtggtaatctgatccatatataaatcaatgttcggaatatcttccggtctgacataatcaattctctgtaattctgctaacagatcactcagaaatttttttgtatcgttgtccatatgtgtcacctcttatcacattatatagttttcaaaaccagatgacaagagacaaatgttgggaaatgtatatgacagtgtcccagcatgaaaaatagaaaatatgttctgtatggtatcgaaaaacagagagaaatgtgttatactttctcatatcactataaacggaaaaggaaaaacaggcatgagtatttatgatacattaaacgagcagcagaagctcggcgttataaccaccgaaggaccggtgctgattctcgcgggagcgggttccggcaagacgagagtgctgacacaccggacggcatatctgatcgaggaaaagggcgtcaatccatacaatattatggcgatcacgttcaccaacaaggcggctggcgagatgagggagcgaatcgatgcgctggtcggatacggctcggagagcatctgggtgtcgacgtttcactctacctgcgtgcgcatcttaaggagacacattgaccgcatcggatacgacacgaattttacgatctatgattcggatgattccaagagcgtcatgaaggagatctgcaagcgcctgaatatcgataccaagatctacaaggagcgcagccttctggcggcgatctcctctgcaaaggacgagcttgtaagtccgacgcagtttgccctgcaggcggcggcatcgagtgattttgcgaagaaaaagcaggcgcaggtctatcaggagtatcaggcggcgctgcagaagaacaatgcactggattttgacgacctcattgtaaagacggtggagctgctgcagacggatccggaggtgcttgcctactatcaggagcgtttccgctatatcatggtggacgagtatcaggatacgaacacggcgcagtttgaactgatccgtcttctcgcgggcaaatacaaaaatctgtgcgtggtcggtgatgacgatcagtcgatctacaagttccgcggagcgaatatctacaatattttaaactttgaaaagcattttccggatgcggtcaccatcaagctggaacagaattaccgttcgacgcagaacatcctaaacgcggcgaacagtgtgattgcgaacaatgtcggaaggaaagcgaagacgctctggacggcaaacggcgaaggagagaagatcgactttgagcagtttgacactgcctacgaggaggcggattatgtcgcaagggatattgcgtccggtgtccgggaaggaaagtacggttacggcgactatgcggtgctttaccgcacgaatgcgcagtcccgtctgtttgaggagcgttttatcgtgtccaatatcccgtacaagattgtcggcggtgtgaatttctatgcgcgcaaggaggtcaaggatctgctggcgtacttaaagacgatcgacaatgcgagggacgatctggcggtgcgaagaatcatcaatgtaccgaagcgcggaattggtgcgacgacgctaaatcgtgtatccgattatgcggaggcgtacgacatcagtttttacgagtccttaaagcgtgcggaggagataccgtcccttggcaagagtgcagcgaaaatcaagccgtttgtgacgtttattcagacgatgcgcagcaagctgccgtatatcggtgtggcggatctgctcagagaggtgatcgaggagacgggctacgtgaaggagcttgaagcggaaggcaccgacgaggcggaggcgcggatcgagaatatcgatgagttgttaagtaaggtggtcgcctacgaggagggcgaagaacagccgacattaagcggtttcttagaggaggttgcactcgtggcggatattgacagcgtcggcgaggagaacgattatgtggttctcatgacactgcacagcgccaaaggtctggagttcccgaaggtctttctggcgggaatggaggacggtttgttcccgagctatatgtcgatcacgtcagacaatgccagcagtgagctggaggaagaacgcaggctggcctatgtcggcattacacgagcgatgaaggagcttgtcatcacgtcggcgagacagcgtatggtgcgcggcgagacacagtacaacaaggtctcacgctttgtgaaggagattccgccggagcttttaaacggcgagatcaaaaagccggcatatctggaaaacagggagcggcgcacggcggagccggtacggaagaagcggccgacgatgcgggatcagctgtccggtcagagcatgcaggcgagagcgttttcatcggtacatacggaaggcggaagcctaagctacggtgtgggcgaccgtgtgtcccacatgaagttcggagagggaacggtaaaagccatcgtgcccggcggcagagattttgaggtgacggtcgattttgacgcggcgggaaccaagaaaatgtttgcagcgtttgcaaaattaaaaaaagtataaaatgtcttaatttataaattttttataggcgaacagggaaagatatgctataatgtgcgtaataagaagacatgcaataaatgaagataaatcaaggaggggaatctgatgaataagatggaagatctgatcaacatgacaaagttaaacgaacttctgaataagaaggaagaagtggaggagaagaagacctccaaggtagtatggatttttgcaattatcggtattgtagcggctgtagctgcagcgatatacggcatctaccgtttctttacgccggattatcttgaggatttcgaggacgatttcgaggatgattttgatgatgatttcttcgaggacgatgatgaggaagcgccggcaaagtctgaggacaaagaggaaacaaccgaagattaagacaaagggcatggggctgcagagagatgcagccctatttttatgtaacaggaaacgctctgtggggatgcgcacctcgtggtgaggtaaataatgctttgcataccgcatcaggcagtctgccaagacaggcgcaagtgtgcggcaggcgcacactttattctgtagcaggaaacgatatcgtaagtggctgagtcaggcgagtgaatcctgcatgcaggattttttatgtttggcaatgtgcagaagaaactggacggacaatggaggatagaacgtgaaaaagggacagattattgaggggatggtagaatgcgtagagttcccgaacaagggaattgtgagaacggaagacgggggacgcgtgatcgtaaaaaatgcagtcccgggacagaaagtgtccgcatcgattaataaagtgcgcaagggaaaatgcgagggaagactgcttgaggtgctggagcactcgccgaaggagcagccggaggctgcctgtatccatgccggagagtgtggaggctgcacatatcagacgctgccttacgaggagcagcttgccatgaaggcgtcacaggtaaaaaaactgatcgatgacgtcattgtaccggaaaatacagactatgaattccttggaatcaaggcgagcccgagacagcaggagtaccggaataagatggagttttcgttcggcgatgcgtacaaggacggaccgctggcactcggcatgcacaagcgtggcagcttttatgacatcgtggatgtcccggaatgccggattgtagacgatgattttcacacggtgcttacagtgacgctagactattttgaagagcggaatctgccgtattatcacaaactgcgccacaccggatatctgcgtcatcttctggtgcgcaaggcggtaaagacgggggagatcctggtggatctggtaacgacgacacagatagcggaaggggaggaagaggcgcttcttgccggatggaaggatgcgttgtgtgctgccgcctatcagggaacgctcaccggtgtgcttcacacccgcaacgacagtgtggcggacaccgtcaaaaacgagggtacggatgtgcttttggggcaggatcatttctatgaagaactgttaggacttcgttttcagattacaccgttctcctttttccagacgaactctctgggcgcggaggtgctctatgagacggcgcgggagttcatcggggatgccctgccgagcggaacggatgcggatgtcgcggagcatggaaaagtcgtgtttgacctttattccggaaccggtacgatcgcgcagatgctcgccccagttgcaaaaaaggtgatcggcgtggagattattccggaggcggtcgaagctgcgaaggagaatgcaaagttaaacagtcttacaaactgcgagtttatcgcgggagatgtgctcaaggtgattgatgagatcgaggagaagccggactatatcgtgctcgatccgccgcgtgacggcatccatccgaaagccctggagaaaatcatccgctacggtgtgccgcagatggtgtatatctcctgcaaaccgaccagcctggcgagagaccttgaggtgctgcaggcgagggggtatgaggtgaagaaggtatgctgcgtggatatgttcccggcgactgtgcatatagagacaatagttgcactacatcggatagattcgtaaaaatccttgattttaggcactttgagaggtttttcaggtttgatcagagtgaccgtaaaacatacaaaaaggcaatttctgatggagtaaacgtgtctgtggtattggactgcggcttcggaaacacatcaaaggaaaagtaatatttttatcattcaacagaataaaagaaacgtgaaagaccgttcattttcaagaaaaattgaaagtgagtggtcttttttatacctttaaaacggatttttattaagacgttttgaagggctgattcgatgtgttcgagaaaggcgatattatggagacgatccggaatgtagatgtaaacagattgcatgatttcaaaaatcatccatttaaagtagagatgaatacagaattgtgcgagcttatgagaagtattgaaaaagaaggagtgcttgtgccacttcttgtaaggactaatccatacggtgatggatatgaagttatatcaggacatagaaggaaggaggcagcaatttgggcaggagagacgaaggttccggttgtgataagagaattagatgatgatcaggcagttgtggcaatggttgattctaatctgcatagagagaatctcaaacctagcgagaaagcatttgcgtataagatgaagctggatgcaatgaaacatcagggaaagcaccttgacagtggggctttggctcaagttggaccaaagtttacagatggaagtcagctaaatgagaagggcaataatacaagtacaataaatagtaatgaattacttgcaagacaggtgggagagagtgtggcacagataaaacgatatataaggcttacaaagcttatcccaaagatacttgatatggttgatgatgggaagattgcattcacgattgcagtagaactgtcttatctgtcggagaatgagcagtatgagcttcatgcagtcatggatttagagcagtgcacaccatcattgtcgcaggcaaacaggatgaaacgtataagtcagagcggaaagctggatatggatgcaatctattcaatattggaagaggaaaaaccgaaccagcgggaacagattaagatttgtgccagtacacttgaggagtatttcccagatgattttactccaaagcaaaaggtggaacttatagagaggctcgtaaaagagtggcatgaaaaacagattaaagataatggaaggaacaggtgattatatgaataaaaatcagaatatacgatttaatatggataaggaatctgatattatggcatgggagagccttcacagcaaagatgtgggggaaagatttaagtcacaaaacaggttcgtgattgaagcaatcaattattattatgagagagttatgcgtatacaggaagatccatatctggaaacaagggaaaaagaagatgcatttgcggacaggatagttggaaaggtagaaaggaaagtactttccaatcttcctgccttactgggattatatgtaaagaaagattatgaggaggaataattatggcgatagacaggacagttaagtttacagtgagattaaatatgcttaatccggctcatgtaactattaataaggttctgaatgagttaaatttggatatatttaagtcaaagaatcagttttttatagatgcagcaacttattatatcgagaattatgggcaggaagaattaacgcagccaaagaaagagaaagagccggagtttgtatcaacagaagatatggaagcaattgaggaaagaatcaggcaggcggcaaaggaagaagcacgtcaggaagccaataaggaagttatgataatggtaggaagtctgctggctgcaattcagactggtggaggtgctatgtcagtaatgaataaagctgatgctgctatggagacaggaacgaaaagcatatctgatgaggagtcagaggattatgaagaagatgagacattagtacagagtgcactaagatggatgataaatgattagcaatagaatatagattatagagacagggactgtgtagaaatacatggtccttatttttatctgcaaatattgtagcgactgccggcataaaacgatggcagaaataaaaagcgactgaacaatccgacggcagtaacttaaaatgccgtaataatccgacagcatggaacttgaacgaaagaaagtcggaaaaagaacaaaggaaaagtgatggcacaaagcgacggcattatataagagcgacggcataaagtgaagtcagctatgaaaaatgctgtaacaaattgccgtcaattaatgtgaaaagacacctttacgagattttagataattatcagagcaagagatgcttcaagcaaggggcaagagaagttcaaatacagccctcggcgtttgagagcgaaatacaccctccgcacaaaacttcgttttgtactccggggatttcgcgattgcatcgagcctgagaataaatattactatggctgcatttgaagaattaaatgtagctgataaaaagaaggagatgatagcaatgccaagacattcatttatacagatgacgaaactccataatgtcatggggagaattgattatataacaagtacagttaaacaggaaaatctatatgccatatatgcgacacagccacttcgttctttttggaaagatcttgcaaaatgcaacagagaagaatttgctaaaagtggaacgataggaaaatatattgaggcaagagagctgattatagcattaccggaaggcttgtatcattatgagcatgattatcttatcaaacattttgctacggatttcaagaaaaagtatggtgtggactgctatgcagccctgcatcataacaaaagaaagacaaactttcatattcatctgatatttgcagagaggacgaaactggaaaagccggttgttaaggtagcatcaagaaacatgttctatgatgaaagagggaaacatgtgcgtactaagaaagagatattggatgcaagtggtgacatccgtaatggctgtaagattatcagaaaaggcgaggtctatgagaaaaaagagttttctataaaagtcgatagatttaaaaaggattcatttcttgatgaggcaaaggtgttttttacaaatgaaataaatcagcttgtgctgcatgaagaggataaacttaaagtctttgataagaacagtccatatcttgctactaaaaaaataggcaaaaataatccaatggaagaacaaataaaggctgacaatgaggtacgacaggaatggaacaggactgttgacagagcaattgtaagcggagtgtcagaagaggacatatcaaggataaagaagaatgaaataacagaaaaggtaaggtattccatagatttatatggagacagaccggatcttcttgcaagtattataaagcttgctattgcagtgcttgaacttcttattaatcgcattatgctggctgcggttggtgtggcagaaaagatgctggatattgtgtcagaagaaagtagaaatattgaggctaagacttatccaacaatgccaacaatgtcaccacttgcaaaaaaatacctaagtcttcagaatatctatgatgaattacaaaagcaaaatgaagcaatatttgcgcaggagcataaacgcagcgagctggagatagaattgtcagaatgtaatggtgcatttaaggcacgaaagcgtggagggttgcagaatcaaatatatgaactgaacaaacagattgataatatgaaacgctatttgtcatctattgtgcaacgacatggttatgataatgtaagggatttttatagtacttattatgcggccaaaggtgaatatgctgattatgtgaaagatgttgaggaatggaatgttaatcacgttaaaaagaatgagaatattccaactgaagagaataggacagatagatatcagattggcgaggaaagggataaaaacagatatatggatagaaactatgtagagaagaaaagataaaagaagatagaatattgggtgatggagtgaaatccctcacccttttttgtgttgataaatgtagaactagttaatcaataatcataacattattttgcttgcaagtgttccgataaaagaatatacttatagtagactaattgtatcgtttggagggaaatcatggattacataacaacggtagaaatgtcaaaaaaatgggggatttcatcaagaagaatttcccttttgtgtagtcagggcagagtgcctggtgcagagaaaaaagggaaaacatggctgttaccaaaggatgcggtaaagccgactgatcctcgtaagaagaattagatgacgtattggaggtgaaaggcacttatgggaagaccagaagattccagagtaaagattccggcacttgtacattttacaaggcttggatatacctatatgtcaattaaagataaagaacgtaacatagactatgatggtgatactaacattttttatagtcagtttttgtctgcaattaatagaattaatcaaacagaattaacacttgcggatgcaaagaaaattatcggagaactaaagattaaattagataatgatgatcttggaaaatcattttttcagatattgcaatcagatattaatggaataaagttgattgattttaatgatataagcggaacacagaatgactatacagtagtaactgaattaccatatgaaaatggtgatgataattttcgcccagatattgttgtgctggttaatggaatgccattatcatttatagaggtcaagcgtcataataaccgtgagggaattctgacagaacgaagtcgtatggagagaaggtttggaaataagatttatcgacggtttgttggaatgactcagtttacagtgttttctaataataatgaatatgatgactctgatattgaaccaattcaaggagctttttatgcttccagcagctataaaagaatgttttttagcaagtttcgtgagcagagagcagaggaattaggggcaaaaatgcaagcaattaatccagaggaggaagcttttattttaagtgatacaaatctgatttctattaaaggaactccagagtatgcttcttccttatcggaaaactcgcctacaaatcgtatcattacatctttatatacaaaagaaagattattgtttttattaaagtatggaatatgttataaaaccacaaccaacaaagatggtattacagagatagagaagcatattatgcgatatcctcagttgtttgcaacattggcaattcgagataaattgagagaaggagttagaaaaggtgtaatttggcacacgcagggaagcggaaaaacagcacttgcatattccaatgtaagattcttgaccgactattttagtaaagaggaggggaagattgccaagttttactttatagtggatcgtttagatttagcagagcaagcgaagaatgaatttgaagctagaggtcttaaagtaaaattgataaaagataaggaagagtttattgcagatattacaaatcccggagagtcaaataccagtgggaaagtgacaatgactgtaatcaatattcaaaagttttccaaggattctgttactaaaccatctgactataatgtggatgtacagagagtttacttcttggatgaggcacataggagttataatccaacaggatcatttctggcaaatcttatggcatctgatagagatgcggtgcagatagcgcttacaggtactcctcttattggagatggatacaatacaaaagatgtatttggcaattatattcataaatattattataatcagtcaattgcagatggttacacattaaagctgattcgcgaggaaattgaaacgacttataagaatcagatgaatgatacacttaatcaaatagtaagacagggaagcatagcaaagaaaaatttatatgctcatcctaaatttgtagaaaagatggttgattatatcattcatgattttggggaaggcaggacagcattagattctactatcggagcaatgattgtttgtgattcttcggaacaggcaagggaagtggacaggcagttaaatcgtttttcagattatacacatgcactggtacttcatgatgaaggcacaaagcaggatagaaaaaacgatcaggaagagtttaagaaaggcaatatagatattttggtggtctataacatgcttttgaccggctttgatgctcctcgattaaaaaagcagtatttggcacgaatgattaaagcacataatctgcttcaaacgttaactagagtaaatcgcccctataaaggttatcattatggatatgttgttgattttgcaaatatcaaagatgagtttgataaaacaaataaagcatattttgatgaacttcaatctgaacttggagatgaggtacaaaactatagtaatatttttaagagcaaagaagatattgaaaaagatctgaatgttgtaaaaaatcagctttttctatatgatacaagcaatgtggtaagttttattaatcaaattagcgagattgatgataagaagcagttacttgatttacgacaagcattagaaaattataaggcgatgtataatctgatccgtttgtatgggtatgaggatttatacgaacatttcaatgtcgagaatgcaattaagtgtctgaatgaggtcaataatcgaattagcattattaacttaaaaaatagcattgattcatcagaggatatgtcacaggtactcaatatggcattggatcagatagatttccagtttcgcaagataaaagaagaagaacttatcattgctgatgcatttagagatagcctggaaaaaacaagaagagaaatcgtagacagatgccttgatccaaaagatccagaatacattgcacttcttgatgaattaaagcgggtattcaagaagaaaaatattgaggaactcacaacagatgaaatgaagcagatgatgggggaactggatactttgaaaaagaaggcagaaaaaagaaatctggcagatcgtatgcttgcggcaaagtattcaggtgatgttaaatacatgagaactcataagagaattatgggtagtccaccacccattgcagatgcaattactgtacatagaattttaatgagtgttaagtctaaggcagatgatcagattgctcataatgagaatatccttgataatgaggattattttattaaatcgttacagccaattattttgagagcatgtatgggagaaaatgttagaatagacaaacctcaacttatgtttatagataattgcctgtcgaaagaatatatattagaaagggattgggtttcctgatgacaacagaagcaataatagcaaatacaaaacagatgatagatgatcttaagacagtatgtaccaattttggacttggtaatgctagtagtgaatataagattataacagagatttttttgtataagtttttaaatgataagtttatctatgaggtacagcaggcggatgaagagttaaaaaattccgagaatgtggagcaggcattaaatattatgtcagaagatgactatgaaatgcttatgatgcttctaccaccggctactgcaaaactcaagagagagcattttatatcttatcttttcaatcataagaatgatgagaagtttaacgaattatttgattcaaccttatgggatatttctaacactaatctagatgtgttctctgtaagtactggctccggtgataagattcgtctatttgatcagaatttatctcaaaatgtaacagagtcaaatcggaggtctgatttctgcaaagctatgattgataaattagttacattcagttttgcagaggctttttcacagaaatatgacttttttgcgactatttttgagtatctgattaaggattataacaaggattttggcaagtatgcagaatattatacaccacattctattgcaagtattattgcaagaattatggtgccggaaggtgtgcagaatgtaaccgtatatgatccggcagcaggttctggaactctggtacttgcacttgcacatgaaattggcgaaagtaattgtacgatttatacacaggatatttctcaaaagtctaatgaatttttgagactcaatcttattttaaataacttggtacattcacttggtcatgtagtgcatggagatacacttctttctccacagcatttgaaccgtcagaaaaatggtttgatgaaatttgattatattgttagcaatcctccatttaatgtggatttttctgataacagagatactcttgcgggagatatttataaagaaagattttgggctggagtgcctaatgtaccaaataagaacaaggatagcatggcaatctatcagatgttcttacagcacattattttttccatgaaagagaatggtggcagagcagccgtagtagttccaacaggatttctaacagcaggaactagaatccctaagaaaatacgagaacgcattgttgaagacagaatgctcagaggtgttgtctcaatgccaagcaatatttttgctacgacaggaacaaatgtatctgtgttatttttagacaattcaaagaagtatgagcaggcaatcttaatggatgcatctaaacttggaacaaagattaaggtagatggaaaaaaccaaagaacggttttatcaccagaagaaatagagaatattatcgatacctttaataactttgaaacaaaggatgatttttctgtggttgtagattatgacaagatagagcagaaaaaatgttcattcagcgcaggacagtattttgaagtaaagattgaatatgttgagctgacacaagaagagtttcagaaaaaaatggatggatatacagaaaaattaacggaattgtttgctgagggaaatgcactgcagacagaaattttggaacagttaaagaaggtgaaatatgagtaggattacaaaatatgctttatctgatttatatgagatgagttccggaatttcatctacaaaagaacaggctggacatggtgcaccatttgtatcttttagcacggtctttaataattattttttgccagatgagttatttgatttgatggatacaaatgagaaagaacaggagatatattcgataaaagcaggagatgtccttattacacgaacaagtgaaacaatagacgaactagctatgagttgtgtagcagtaaaggattatccaaaagcaacttatagtggatttacaaaacgccttagacctaagaaagaaggaatagcatatcccaagtacatggcattttattttagaagtgaattgtttcgtaaagctgtaactaataatgcctttatgactttgagagcaagttttaatgaggatatttttacgtttttggatgtttacttgccaatttatgaagaacaggtaagaattggggatatgctttatgctgttgagtgcaaaattcaaaaaaataaggagataaatgattatttagagcagcaactccagctgttgtatgattattggttcactcaatataattttcctaacgaggacggacaaccatacaaggcttcaaatgggctaatggtatggaataaaatgattaatcatctaattccagccgattggaaagttaagccactggggacaatatgctcttttcgtaacggtattaactacgacaaaaatgttgatggtaataccatatataaaattattaatgtacgaaacatttcatcttctacgctttttcttgacgaaagcaattttgatgagatatgtcttccaaagcaacaaggtgataaatactatgtatctgatgatagcattatcattgcccgtagtgggataccaggagctacaagaatattatgcaatccaagtagtaatataattttttgtggatttattatttgttgtacaccatctgataataccttacaaaactacttaacattatatttaagacaatttgaaggtagttccgcaactcaaaccggtggttccattttgaagaatgtaagtcaagaaactctgaaaaatttgattgtgcctattccaccacaatcactgttaaatcagttcaatgattcaatattacctatatataatcttatcaatagcaacaccaaagaaaatgtgcagcttatcactctcagagactggcttcttccaatgttaatgaatggtcagaccaccatcgaagattgatatgataaataatcatttataatataaaaaataactcttgaaagtggcgagagcaaatacaagaactccacttcatggtggttctcacatataaaggagaaacacatgaaagagaaaataatatcagagatcataagagagatgatttcgtcactaaataatgaacaattaagcaagttgaagactacattggagatatatctttataatgtttccattgaagccaaacaagaagctgatacagagaaaaaagaagtggattatttggaagtatttctttctgcaaaaaggattgaaggttgttcagaaaaaacactgatatactataaaaatacaatacagcaaatgcttgatagtattggaaaatcagtttgtacaattgttacagaagacctaagaacttatttggcggaatatcagaaggagaaacaatcaagcaaggtaacaattgataatattagaaggatattttcaagttttttttcttggttggaggatgaggattatattattaaaagtccagttcgcagaatacatagaattaaggctgctagtactataaaggaaacgtacacagatgaacaattagaatctatgagagataactgcgataatccaagagacttagcgctgattgatattttggcttcaacaggaatgcgtgtgggtgaactggtgctactgaacagagatgatatttcttttgatgaaagagaatgtattgtgtttggtaaaggagataaggaacgcatggtatattttgatgccagaacgaagatacatttgcagaattatcttgattcaaggacagataataatgaggcattgtttgtatcacttaaagcaccatacaatcgaatgaaaataggtgggatagaactgagacttcgagaaatgggaaagcgattgaatatagagaaagttcatcctcataagtttagaagaacactggcaacagtagccattgataaggggatgccaatagaacaattacaaaaattattaggacatcaacgaatagatacaacattgcaatatgcaatggtcaagcagagtaatgttaagattgctcatagaaaatatattggataggagaaatgtctttatgaaaattaaggatataggacgtgtagtaacaggaaaaactccattaactggtgtgaatgaatattatggaggaaatataatgtttatttcaccttctgatttacacggtgattacttgatagaaaagtctgaaaaaactataactgaggagggattgaaatcaatagaatcaaattccattgatggaataagtgtgcttacaggatgtataggatgggatatgggaaatgttgctatgtgtaatagtaggtgtgcgacaaaccaacagattaatgcaataatagattttaatcataaattggttgatccaagatatgtttattattggttaaaagggaaaaaagattatttattttcaattgcatctgttaccagaacaccaatacttagtaagagtgtttttgagaatatagatattcctcttccaagtttgaaaatacaagaaagagttaccaagttactctcacttattgatgagaaaatcagaaaaaatcaccagataaatgattatttagcacctcaatcttcgatggttgcttgaccattcatcaagattggaagaagccagtctctggtttgcactagaatgttattttccttttgaagttgtatgattttggtgtccataggttcaatctgattaatgaattgtgtacggatttctttgggaatattcaaaatgttataactgttcaaattggcttgattaattttcagttgtattgaaccggtttttatcattgatacaggtatatttttcaatagtagatataataaacggcaggagtaaccattcacaggttgtaaaacatgcgtatgattattaatccatacatcaccagatattcgttgtaatattggatttccattgtcatccatcacagaaccgtcttctgctaaaagtacaaaatctcctgaaaaaatcggacgattaacataatccattatcccagttgcaccataataaggaattgtacctttcatttcctcacgttgatgactagaaagtggaattctatcagaatcaaggcattttgtaatattcccgacggatgtatattcccaattttgaggaatatttcgatttagttccttgcaaaatatcattttacccccagaagatttgtatggatttccgttttcatcaggaaaatcaaattgcacaaaccaatagtcatagatggtctttgccatctcttctaaataatcatttatcagagaaataattattatgatatgggctatcatattacaagaatattggatattatttaataaataacaaaatatgcaaagaaaaggaagacacataatgttttacgatacattaaatacagaggaacaagtttcatacttaataaagccaatcatagaagtgctacaagaagccggggggcaattggagagagcagaaattagggatagaattagcgaaaaagacgagaagattgctgaatttgaacaaaagctatatacatctaataaaaccggttctaaatataagaaatttgattttaagtttaattttgctcttaaagagttaagttatttgggattccttacatatgttagatataaaccacttgtgacattaacggaaaaaggagccgctgttgatgtttcaaattttgatgttaagaaggaggttcgagaaaaggcagctgtttattgggaagaaaaatcagctaagaataaagagaagaatagtgtaatgccaaaagaaatcgaagatgaaaacagtataaatgctgatgatatattggatgatgttaaggtcaaattgcaaagtgcaatagcaaatatgtctcctaagaaatttgaacaattctcgagagcattactgactaaaatgggagtacagtttacggataagggtattaaaatatcgaatgatggtggaattgatggatatggatatcatacagacgatgatgatttcagaacaaccagagttgtaattcaatgtaaacgatataacacagctcctgtgagtgagcctgatataaatcagtttttgggggctatgaataaatttcaggcagattatggagtgtttattacaaatagcagatttactaatgcagcaagggaggcagcaagagaaggtacaccaataacgttaattgatggcaatgatctggtaaggcttgttattaagtatgaactttatattacacctgtaacaacatatgtacttgatgacttttatgatgaagaatagttacgtcggttatattaatagaaaacatggtgtaacttctctcactgattgtacgtcatgcaactattttttatagcacataattttttcccatttttcaggaaaacccattttggaaaatagcagctcctggctgatgtgtgggcagttcttgcgaacggaatgaatcaattgtttgagctcagctttaaattgtttaaattcctgattgtcaataagataacgcaaagcaatcactactgcgaatagatccttctttccaatagcatattgtccttttttccgtggtagttgtaatttgctatgtaaaacagtatcagggattgcttcatttacttgaaatgaataaagtctctcgttgtgagcacatacattcctacagcttgcgaggatacggatgagctgatgcaactgaacctctgacatattggcaaaattcagactaaccttggtgcggatatcagaagtcgtatattgatacatttttgaaatttgtccaaacgtaagcgcattggttgctacccataaagggacatttccatacattgttgcatgatgagtgatataactatagttgcttggcaaggcgatagttttacttaaggtagtaatcaggcgatttattttgctttgatttctgcgagtatagttataattacctgcagttaaatatgccgtctgttgttctccatatttttcgcaaaagtagtaggaaagcatggatttcaactgtctttccacatgtaagatatattttagaaagagcgttcttaattcttcgtcaaagtaatagaaagcggtaatttcttcaaaagtaacaccatgtagataattaccggatggtttatgtttaaataaatccttataaccgccgattaatgaaaaatagcctaacttttgtaaagtggttttggcaaattcaggatcggaaataacaagctgtttttctttttcaagcttttcgatttgctcatcatatgtgaaaaatgttttattagccatttctgaatcctcctttattttggcataaaaaaagtggagtccacgcatggaactccaccggctgcgggcatcgcaagtttccgcagcgcaaccactaaagatactataccattgatatctggcgatgtcaaacagtattttttagtggcattaatagtttatgcgtttctgtgtgtgatattcttattttgttcattcttggcattcagccatttttctttatattccagtgctttctcaggcttgtgccatctggcatatagattattcagatatccgtatacagatttcagatagttattcttagaaacataattatcaaatgctgaaacagcagtatcagatgaagctaaatcagaatcactggtatccatagcagcattgataatactctctgctgccagtagattcttttcggcttctactggtttaccttcctttaatgcaattattccggaagcaagtcggcagcagccataatctaaagtgttgtagccttcgttatctgttacaagagcatcatattgattaaggacaagccgtgcaagctctaaatcaccagcaagtatcagcatatttacaagattaagcatctgttggagcatatcatgcgtttcaattatgccggtgtcagcatatgaaatccttatctcaaatgccttgtgtaaggcttcggttgctttatcagtttttttaagtgcaagatatacattggacagattgttataaagatttgagagtagattgatatagcgcttctgattcatggtgttcatagtgtcatcttcattttcaagcaggtgtatagctttttcacgtttctttacagccacatcataatcctttctaatgtatgaaagctctgctttgtagtctaaaagtaatgctctgtcacagacagaatcgatatgctcctgttccataaggtatgatatccggtcagccagttttgacatataatccctgacagagtatttttcaagatatggaaacatatcctgaaggaatagcagataacaggcagaattatcattgatgatgttttctacaacacttatcatagcctgtatcgtattatcgggctttcggacttctaagccatgcatcaagcagattgagtgaagactgtttacaagtgtctgacaattggaaatgcaaggatttaattcctcatatatgatttcctgtatcagaggatgcaggtttattttcttattctctatgtcatctgttataaaaccatatcgggcaagataattaacatcatgtaaagaggcgagctgcagccagttcctgaaatgattcttatacacgccggataccggaaggattgacaggttcttaagtatatcggtttgagaagagttaagccggctgatctgcataagaatacgcaaatgttcaatcataagcccatcataataatccccatctttatataattccacattttcactatctgtgatattaagcccacactgctttaattcatgcagtaattcatcaggctcaagaccgcctgctgcaagtgaaagagctgataatacgacagtcagggtgtgggaatgaacttctcttattatctgtttaactgtttcagtatcatcatccgaataaggacaatgcgaagcaaaaagctgtaaaaggtctttttcagatgctatctctttaatcttaatcgaagcatattgttttacttcacagcgtgtcgtgacaagcaattcaaaatcattctttacaaattctttgaaaaaagcatcatccttaggaagtgcattaaagttatccagtatcacaaggctgtcctgatgcagggagcgtagcagtcggtaatgtgagtcaaatagagcatcctcatccatatctgatgtatcatctgaaaattccatggctgcaatgtcttttcgcaggctgccggaataaaacaggtagatgatattggtatatttctttttattcctgctggcataatattttgccagttcactttttcctattcctgcgattccatttatgaaaacaacggattcagaagcaagcagtctgccacattcttttatctcatcatttcttccgatgaattcttttacaacagccggcaaacgattacttagcagaatgtcagtaagctccggtgaatacaggttctttctgttatggtcagataatatggcgtaaagcataacatctgtaaaaaatgtggcattatcatcaatggcaattaattcatcagctttggtaatgccaattatttttcggctgttattaatcatatcttccaacaagtatctggtattagaaacatttataagattaggaataatcttgttcttaaagtccgtaatcatctgattacgcccggtatcatttttgtattcattcagaatatctacaggaacaggtcttgctccattacaccagcggctgaaggtgatgttatcatctgaagcttcaccatagtcagaggcttcatccaacaggcagagcgaaaacaggtcacgcacaagccggtgctgtgggtaagtctttattttattgtcaagtaatgcacctgtcacatgtgcaaatgtcaattgatttttcatactttctccatgtctatgtcaacttccagtcaacatgtcgtcaatgtgtttcattctcaaaatttactatcattatcacaacaaaacatagccagcagacagcagaagatatctgaaatggctataaatattataacatagaacaaacatatgttctacaacttttttgcacattgaaaactaaatgagctttatcatatgccaacagaaccagcgaagatgtttccggtaggaaacggagcgggtgaagacacttccgtcaagggtgggaaacggactcgaacaggagtagcccacaggtcacgaagcgattcgggggactaaaggtcagctgtgagactgacaacatgtgatatgcagaaagccaaatgaagtatctttcaacggtatgattatcacaattgagatttcggtaaaagaaggtgatatgtttagtattttaagaagggggtgtttacacatggcaaaagaattagaattagccaagaaactggctgtacttgggtggattttccgcaagggactgattaccgaagatgagtacagtagaacaagagttcatattatgagtgaatatgatgttataacttttatgacagcatagccgcacattcgttaacatttatattttgaattatagtgtaggcagtagcagaaatgatgttactgccaatttattttatacagacagattttagggaaggagcgttttctatggatgaaaaacaggtagaagtaataaagaaagtggatggtcctgttatcagagaccgcagaaagatgggaaagccacttactattacaagaaaaagagtagcagcatatgtccgtgtcagcacgaatggagaagagcagatacagagctttaattcacagaagcagtactatcaggataagatagattccaataaagagtgggttatggttgggatatacgctgatgagggtatcacaggaaccaaaacaacgaaaagagagcagtttcttaagatgattgatgattgtatgaatggtcttatagatattgtaattacgaagtcagtatcaagattttcacgaaatcttgttgatacactgcaatataccagaatgctgaaggtaaagggagttacagtaatttttgaaaaagagaatattgacacatcaaagatggaaagtgagatgcagttatcacttttatctgctcttgcacagaatgaggttgagtctttatcccagaatgtgacaatgggtgtgcagatgaaaatgtccagaggagagctgatgggatttaacggatgtctcggatatgattataacccggaggataagagtataactatcaatgaagcagaagcagagacagttcgcctgatttatgatttgtatctgcagggatatggtgcatatagaattgcgaaggagcttacgaggcttggtaaggtcaataaaaagggcaatgttaagtggacagacagcggtgttaggggaattcttaagaatgaaaagtacaagggcgatttgcttatgggaaaaacttacacagtagacccgatatcaaagaggcgtctggataatcacggtgaatccaataaatattatacgaagaatcatcatgaagccattatttcagaggaagagtgggataaagttcaggatattttaaaaagcagatatcgtactaatgaaaatgtatcagatgcggagagaatcaagtttgcaagaaaatacgcttttagcagtatgtgtcagtgtggtttctgtggaactaatctcaccagacgttcccataatcaggatacaaagcataaaaagccggtatggaaatgccggacggcaacgaataagggaattgcaaactgcccacatagcaaagccgtagatgaagtggttatcgaaaatgcgtttcttgagatgtttaagttgcttgcagagaattttgatgatgtacttgaatctgtgttgtcatcagtggaagaaacattatccaaagacgacagtacagaaaaattgaagcgtattgagaaagagattccctcgcttgaaaagaagagaaaaaaattgactgatatgtatctggatgataaaatttctaaagaagcctatgacgataaatacagtgagattagcaataagttggataaatgtgaagaagaaaagcatttattttctgactgcgtattatcacagaagaatattgctgataagatgaaactcatcaggcagaagcttaaaggggctgatgtacttgatgaatttgacagagtagtatttgaaagcattgtggagaaagtcgttgtcggtgatatggaagaggatggcaaagctgatccgtataagctgacatttgtgctaaagggtatggatgacagaagtataccatatgccagagaccgatatatgaatctttgtgaaaaggctgtgtagacaacaaggaggagcttaaaaatgagcgataatcatgacttgttgaatgataaagatgtgtgttcttttgaagaacacgaggcagaaaatgtgtgttccaacaaagatgccgttgcatgttgagacggttgtactgctttcccacaaaaagccagacggacatatcaacgtaaaagttgagtttggcgaaggtgagggaaaagttccgcttgataatatcgctaaaagagccgaagagtacaagcccaaggaacgagtgacctacaaaatgataaaggagtacatagaagctaaatacggcttcaaagtacataccgcatatatcgcagaggtaaagagagatttaggattgccgatgtatgatgctcctaatgcggtagaagaattgaaacagccgaggaagcatccgacagcggagaaagtggaagcgataaaggatgcattgaaatattttggcgtatgtagctaatttttagtgcatagttataaaatttataaaacgacatttaccgttctatatggtaagattaaatatagtaacgattttataaatgtaggtggtaaacatgggagataatcgaaggatttttagtgataatgaaaaaatggtattatttaatgaggtcgatgggcgatgtccaatttgtggaaagccattaactaataccaagaatggacaaattattaaaatgtttgaagtggcacatatatatcctgcgaatcctcgtccagaggaagtcgaattgttaaaagacgaggaacgtttgagtaaagacgttaatagtctggctaatgtcatagcggtctgtagaatatgtcataaaaaatttgatacaccacgaactatagaagaatatcgctcgtgggtaagacttaaaaagaaattgttgcaagatgcacagctaaaaaatacatatgcactttttaatatagaggaagaaataaaggaaatattaaagaatttaaatgatgaatctttagaggaagacttggtacggttaagttatgaatctttgaagatagagcaaaaagccaacgacaccttaccttttgcaataaaacgtaccattaaaaacgatgtggtagattattttgactatattcataagatatttattgaaatggacaaagtaacaccatataaatttgataccctggcggctcaaataaagggattctattgcaaaactatgcaaattaatcctaaccaagaattcgtatatgcttctttagtggattggcttaatgaaaagacagggtcatattcaagaagggcttgtgaaattgtgattgcatattttatacaagattgtgaggtgttttcatgatattgccgaataagctaataagctttcaagattgtattctggcaaaaacggtttatattttagaaaagattagtgattcagatttttcagtaattgggttatacgaacaagtggaaactcattttgaagatttaaatgaatatatgttggctctggacgttctatatgttcttggcaaaataaaatataatgaggggttgcaggtgatacagtatgttgaaaaaaattagttgtaatatatttttgcagaaagaaattgtatttcatgagggtttaaatgccattgtaggagatgatattgcttctaattcgataggaaaatcaactatgcttatgattattgactttgtttttggaggcgatgattatataagtaaaaatcatgatgtagtagataatttgggtcatcatgatttcagatttatttttaattttgataataaggattactattttattagaagtacaaatgaatacaaatttgtatctatttgtaatgagaaatttgaaattttacagagtgtaacaacggaagaatttaccgcatggttgcaagaaaagtatgattgtcaattagaatcgttaacatttagaaatattgttggtagatatttcagaatttatgggaaggaaaatttaaatgaaagaaaacctatccagtattttgaaaaagaaacagcacctaaatctatattagctcttttaaaattgtttgataaatataaatcattaaaagcatatgaggagcaaatagaaaaattaaaaagtgacaaaactacattggttgatgcagcaaaaaagaattttttgccgaatgtcaacacaaaaagtttatttaataaaaatgaaaaaaagattgaagaattaagcgtacgattagaaaaaataaagaaggaaattgtaacaacatcgcttgatttagaatcaatggtttctcaagaaatattaaaacttaagagggagaaaagccaacttactattaaattaaactcatatcaaagcagattgctaagaacacaaaataatataaagaataaacctgtgaaaattagtgctgagttagaacaatttgtgtattattttccagattttaatgtagaacaggttaataaggtggaggatttccataaaaatataaataaaatattaaagagtgaacttgtagcagtagagaaggaattaaaagctaaaatcgaggaaattaataatcagataatagaaatagataaggaaattgaacagaaattgtccataaaagatgcacctaaattagcagtagatgaagtggttgatttggtggcacaaataaaacagcttaatgatgaaaatggatactataccaagaagaaacaattggaggggactatatcacaggctaatgatgatttaagtgaattaaaagaaaaggcattagatgaaatatgtaatgaaataaatgtcaaaatgtacgagctaaataaagaaatatatgttgatggaaggcgagcaccgacactgaatattcacggaagtaaatattcgtttaatactgcgggggatactggaacaggtacagcttttgctaacttgatatcatttgatctttcattgctggaattaacccgtttgccggctatagctcatgatttgccattgttaaaaaacattgaaaatgttgcaatggaaaacattatttcaatatatagtagaagtgaaaagcaaatattcgttgctattgataaattgagttcttatgatgagaaagcggcacaaattataaataaacataaagtattacaactttcgaaagacaaattactctttatcaaaaattggaaaagcaataaataaatctaaaaagcgtatcgttagaaataatggtacgcttattttttgcccctttttgcagatttgtcctttctcatgctttccaatataatgaagctaaagaagtggaggtgtgcttatgagagagaaatttaatcatctgtatttggatagccacgaaagaaaacttttgatacatagccttgtagagttaaaaaatcagcgcatacagcaaggcagatatacggattgtgttgacaagcttatttttaaggtcataaatacaccgaccaagagaatgaaaattgaatatgtctaaggcaaattacaaagctgcttattcttattgattttaagagtaggcggcttttttgcgttctctggtactgtttacatagctaccttgacaaagtggctaaatctatgtgaaaggaggacgcatctatgtcaaattgcaaagtgattgctctgactaaccagaaaggcggtgtcggaaaaacaaccacagcggttaatctgggtgtaagtctggtgcagcagggtaaaaaagtcctgctgattgatgccgatgcacaggcaaatcttacgatggctctgggttataacagaccagacaatattcccataacgctttctactgtaatgcagaacatcatagacgataaaacgcttgatgtttcacagggtattatccaccacagagagggcgttgacctgcttccgtcaaacattgagctgtcgggctttgaggtaaggctaattaatgcaatgagccgtgagcgtgtgctgaaaacctatgtcaatgaggttaaaaagaattacgattatgtgcttattgattgtatgccgagcttaggtatgataaccatcaatgctctggcggcggctgacagtgtaattatcccgacacagccccactatctctctgctaaaggtctggagtttttgcttcgctccgtatcaatggtcaagcggcaaatcaacccaaagctgcggatagacggtatcttaatgactatggtaatgccccgtaccaacatttctaaggaaattacggcaacggtcaaaagtgcatacggtcagaaaatcaaggtgtttgataccgagataccacattctatccgtgcggtggaagctaccgcagaaggcaaaagtatttttgcttacgacaaaagcggcaaggttgccgtagcctatgagcagttaggaaaggaggtggcagagattggcgagaagcagagaagggttgacaaggctcttgccattagtgttgcacttaaaaaaatatgaaaaaagtgtaaagcaggtatgagggatagatttgcacattggtaaaatggcggctgtatttctataatttagaggtacagccgttttaactttagcggaggtattcgtttatgggaaatgaaaatttaattcaaaatacagaactacaaaacgaacagttgaaagatgaaaccgaaacattcaattcttttatcaatgttatggtgcaaatagttgaaaaatatggaaagaccgttttgcaggaattggattgtgctgcgtaggttacgcagccttacatatcacatttccctataaatttatggaggtggtacgatgaacagagaaggaaagaaatgtgttctatatccgagagtaagtactgaaatgcaggtggacggatatagccttgaagggcagaagaatagcctgaaacgatttgctgacagagaggaaatggagattgttggtatatatgaagatgcaggtaaatcgggaaaatctattgaggggagacctgcttttaagaagatgctttctgatataaagaacggattggagatagattatattctggtttataaactttcacgatttggaagaaatgcggcagatattctaaattcattggagtttgtgcagtcgtatggaataaatctcatttgtattgaggaaggtattgactcatcacagacaagcggaaagcttttaatttctgtattatctgcggttgcagaaattgaaagagaaaatatcattgaacagacaatgaacggacgcagagaaaaagcaagacagggaggttggaatggcggttttgctccgtatggatattatctgaaagacaatcagctcttaatagaagaaaccgaagctgaagcaattcgaattatatttgataagtttgccaattcagacatagggcttggcggagtcgcaaaatatcttaatttgcaaggaataaaaaagataccccgtcagaatggaacattagaaacttggagcagccatttcatacggttgatattagataatcctgtctattgtggcaagattgcttatggcaggagaacacgagaaaaggtaaaaggcacaaaaaatgaatataagcaggttcatacagatgattatattctggaagatggacaacacgaaggaatagttagcgaagaattatggcaaaaagcttacacaaaacgtatggcaacaggaattaagcagccgtccaaaataggtaaggacaggtcgcatctgttgacgggaatattaaagtgtcctatttgtggaagctcaatgtatacgaataaacatgcgtggacgaataaagatggcacatacaaagaagtttactattatatctgcggtaggaacaagcaggagcgagggcatcattgtgattacaaggcatcgcttagaaaaacagacattgaaccacttgtaattgaagctgttaaagaattggtaagtgataaatattttgcaaaagagatagaaaagcgtattggcgtacagactgataccactgctattgataaggaacttgccaattatgagagcaagctgaaagaagtagatttgaataaagcccgtctggagcgagagattgataatctgcctattgatgctcgtttcagagaaagaaaaatccacgacatgacattaaggcttgatggattgtatgatacgattgtcgagttggaagaacggattgaagatgcaaagctgagaagaagttctatcgaaatggaagcaattactatggacaatatttacaagcttatgctgaatttcggaaagctctatgatataataagtgacgaggaaaagaaaagccttataacttatctaataaaggaaattcagatatatcctaatggagagtcagagatgcctttgaagtcgatagagtttaatttcccgatatatcgtgatggacaagaggtaaggcggctcttgtgggaaaaaggtaataccgttgagtcggtggttctgatgcagtattgtgggaaatgagaaaaataggcatgttaaaccacaagatgttgtggtttgagggcaaaaattggaacgaaaaatgaccagtttttgccctatttttttccccgtttttatagatgcataggtgcaaaaaagagatttttgggtgatttgagcaaaaaagagaggaggaaataaaagtaaatagcagatgaatatgtgaggcggtacttattttagagatgaaataggtactgccttttttattttcaaaagaacaggaggaagaaaaatgtcaggattgctttggataaaggacctgagtaaagagatacttttgacagtaaatatttgaaaatgtttttttatttatactcaaaagaattagttgcatcactatatgaaagcagtgatttttagagatataaagttatgttttagtatatttgacaaggtaaaaaaattatgtaaaataattacttggaagtgtgaaaacatataacttggagaaatggagaagtaggaatggcaacaataaaagaaattgcagagattgtaggtgtctctagtgcagcagtttccagagtgctgaattatgatgaaggaatatcggtcagtgatgagacaagggatgcaattttttcaacagcagaaaaacttggatataaaaaaagagttatttatcctaaaatcgaaaatgtcgccttattatactttacagataataaggatgaactggaggatgatttttatcgtggggtcagagaagagattatcaaacaggcaaagaagatgaatattcagttaagcatttatgaccgtaatgacggaatggatgcgattccgaaggatttgaatgcttttattgcagttggctggcttgccaggaaagaaattaataagctctataagatatgtaaaaaaggtgtatttattggaacttcgccggatgaaaaactgtttgatgcggtaaagccgaacatggattcatttgtgacgcagatggttgattattttattgaaaaaggacataaatctattggttttattggaggaagtgaccgaaacattgatacggggaaaccggctatggatatcagggaatggtcttttcgacaaagcacagcttattacggttgtctgaatgaagattatattctgatttcagagaagtttacggtagatgacggatatcgtatgggaaaggagttgttaaaaaagaaagcattaccgacggcactctgtattgcaagcgacacattggcggtcggagtgctgcaggcattgaatgaagagggagttttggttccagagcagatggcaatattcagcatcaatgatttaaatatagcaaaatacatgtctccaccacttacgaccattcatatagatattccctgtatttgcgagacagcattggatttgctgaggaatcgggtgctgtatgggggcagagtgacgaaattggtttttgtgaatggaattccgatttttcgaaagagttgttagaataaaagagatgccagaaaacatggcatctttttttgtttctgtaaatggataatatgcacaaaaatagaatgcaaaaattgttaatatagtgcaaaataatatgtctctattgaaatttgtgtgtaagaatgatacaatctgaacaagtaaataatttacctaaaaataagtaaataattgattgagaaaagaaaaggagaaagcttatgaagaagagaatggcaggaatgctcttggtagcagggatgatggcatcactggtaggttgtggaggggctgatgcagctaagactgcaaccgcagatgcgaatggaaactatttggtaaacggtagttttgaggaagcagattttaccggatggacggtaacaaacattgatgacgttacagaggaactggatgtgtatgaccgtgaaacagactgttttgaaggtgtacagtctttacatttttattcgggaagcagcaatgtgaatttttcagcagaacagacagtaagcggattggaggacggttcttataaactaactgcacacattcagggagaggctgcaggtgatgaaaatgcgcaggcatatttttatgcgattgttgatggcgaagaagtgaaggtcgatggtgagctgaatggatatgtaaactggtacacggcagagctttccgggattacgccgacagatggaaaaattacggtaggtattcgtgtttcaacagctccgggtggctggggaaccattgatgatttgacacttgtgaaggagtaaagaatggaatttataaaaggcatggacatttccatgattaaggaattggagcatagtggagcgacatatcggctgaatgaaaaagaggaagatctgtttcatctactgaaagagtgtggaactaatatggtacgaatccgaatatggccagatccctatgatgagaaaggaaattcctatggaggtggtggaaatgatctgcagacgactattggaatcgcaaaaagaacggtggaaagtggaatggattttatgctggacttccattatagtgatttttgggcagatcccgcaaaacagataaaaccaaaagcgtggaggaaattaacgggtgaagcactcgaaactgcggtatatttgcataccgttgatacattaaaggcactgaaaaatcgaaaactcgttccgtcaatggtgcaggttggaaatgagattacgaaaggactgctttggccagatggatatgtagaccggtcggaaagcatggcaggacttctttgggcaggcatcaaaggagtgagggaggaatgcccagaagctaaaatagtactgcatcttgattttggaacggacaacgagatgtaccggcaatggtttgatcggattgctccctacagattggattatgatgtgataggaatgtcgtattatccgcactggaacggaagcttaaataagcttttagacaatatggatgatatcagcagcaggtatgataaggatgtgctggtggcagagacatccataggctatacaacggaaacgtttggctgtaacggtattgtgtattccaaggaacatgcggagatgaccgggtatccggcaacacaggaaggacaagaagcttttttaagagatttatttgcaactgtaagaaaagtaaagggtgcaaggggaatcggtgtcttttactgggaaccggcatggctgccagtagaaggctgcacatgggcgagcaaaagcggaagcatatatatgaaagagacagaaacagcaggaaatgcaatggcgaatatggcgttgtttgatgaaaaggggaatgcgaacagtgcattagtaaatatgaaaacaatgtaggaggaaaagttcatgaagaaaaaaatcatgttatcgatgcttgtggtactcacgacagcaggaatgctgtcaggatgcggcaatctgggaacagcagattccaaactcgttatttggacaaatatgagcgtggaagtggataccatacaacaatatgcagatgaatggggagaacagaacggttatgaggtagaagtaatccatcagtcaccgtcagtccagcagtttgcgcaggcagtaaaaagttcttcgggaccggatgcagttgtgggaattccaaatgatcagcttgcagattatgtgaatgcaggtcttacggcagaagtgccacagaatttatatacggatagtgatttttcggatgcagccattcaggcatgttatgtagatggaaaaaggtatgcagctccgctctcggtagagacaacagcattattttataatacagatatggtttcagaaattccggcaacatgggaggaattagtagagcaggcggttgacaacggcggcgtccagtttgatgctaccagcatttattatgatcttgggtttgtgagagcatgcggtggatatatctttgattataaagacggcgcatatgatacaagcgatattggtcttgcaaatgaaggatctgtggaagcatatgggtttatcaatgacttgtgcaaccaatataatctgcttacagcagatgttacagctgatattgcaagaagcaatttccaaaatggaaaatgtgcttattatattggcggaccgtgggatattgatggctttacttctgcaggaacaccgtttgcgatttctgagatgccgactttcaatggtcagccctttgtgacaccggtaggaactcaggtaagttttgtaagcaacagcagtaacaatcaggagcaggcatggaattttatccagtacttaattgaaaatggcgcattgggtatgtatgaatccggagacagaataccggcaaagcttgcagaccagcaattggatgaaatacaaagtaacgaatacacacaggcatttatcgcacagattcagaacggtgagccaatgccgactgtttcagaaatggggcagctttggacaattcatacgaataacatcaggtctatgtgggcaggggaacaaacaccgcaggaggcgacggataatatggttacccagctgaaagaagcaattgaattgatgaattcgggaaagtagtgatggtatgaaaaagaaaaagaatggtatggcatatgcttatttggcaccggcactgatatctatactgttggtaacatgcttgccgattatctatacggtaattttgtcttttacaaactataatatgtatcatttgaatgattacagctttgtcggactggtaaattacttgaccgtattttcggggagcataaagaatgtgttttttccagtgcttggatggacgatatgctttgccgtattcagtacggcaggctcctatacaatgggacttattcttgcaattctgttgaacaacccgcatatgaaggagtcaaaaatttatcgggcgattcttatcgttccctgggcactgccgtctaccatcgcaatcttagcatggcagggattgttaaatgagcagtacggaggtattaataatcttctccatgcaatcgggattgcatggaatataccgtggttgacgaatgcattatgggcgagagtaggactgatcattgtaaatgtatggcttggatttccctatatgatgaatgtttgtcttggaggattacaggcaataggggcagaatactatgaggcagcgaaaatggatggagcttcaaaatttcagtgttttaagagcattacgttgccgatggtgacaaaattgtctattccgttggtgatttcctcatttgcagctaattttaataattttggaaatatctatatgattacgcagggtggaccggcaagggttgataatcagtttgcaggatatacggatattcttgcaagtacgacatataaaatgacaacatggtcgaaccgatatgaactgtctgctacgtttagtgtgctgatttttattattgtcggtacttttacgctgattaatatgcatttatctggtgcatttaaggaggttgattaacatgaaatataaagagaaaatgacagcctctgaaatgagaaccctgtggggtagcagaattgtaatctggattacgatacttgttgtgatgtttccggttgcatggattgtaatgtcttcgttttcagcaggagatagcttttttctgtcctcactttttccagagaaattcagtgtggagcattatgtgacactgtttcgggaaaccgattttacaatttgggtattgaattcattaaaattttgcttcatagttgcgatcattcaattaattcttacttccttggcagcgtatgcatttgccaggcttcggtttgttggaagaaagtatggattaatgtccctgcttgtgctacaggtgtttccgaacagtatggcagtggcaggctattatatcttaatctatcagttcggattggttgacaacagtattgcacttattctggtgctggcaggtggaagtgcctataatatctggttgctgaaatcatatattgacggactcccggtagaactggatgaagctgccatggtggatggagcgaatcagtttcaggtattctataaaatcattataccgcttgcaatgccgcagttggcagtcatatttttattttcgttcattgcgacttacagcgaatatgtgattacatccatctttttgcagacaccggggaagatgacactggcattggggctgcagtcattcatcagcgatcagtttgcggcacactggacactgttttctgccgcggcagttatttcatcactgccgattatgattgtattcatgtgtctgcagaggttcattcagaatggattggttgctggaggcgttaaaggataacattacaatttttagtgagaaaggaagctaatatacctattgctccatcaatatacagcttatgcaacaagatggataattccttactggctgtaagggatattaaccataaatacattgtagtagaaaggagattctatgagaaaaaacaaatttttatcagttatggcagttgcgcttgcagcagtacagcttataagcgcatcgacagttacggtgcaggcatcaaccctcacgggggcggttgagacagatgattttataaggggagtagatgtgtcaacgttggatatgttggaagatttgggtgcacagtattatcagaataatgttgcgaatgatgctttgacaatcttacataataatggggcaaattatgtaagattgaaattatgggtagatccctatgatgaagacggaaatgcatatggtggtggaaacaatgattatgacacaacactggcacttgcaaaacgagcccaaaatttgggaatgaatattctgattgattttcatttaagtgatttttgggctgacccggcaaatcagattaaaccgaaagcatgggaggacttatcatattcggaattgaaagaaacattgtattcatatatgaaaacaactttgaataattttgcatcagagggaattgttcctgattatggtacaggttggaaatgaaatatcttccggaatccttcatgaagatggagaaattggaacagatgaggatttttccggactggcaggacttttgcagtcggcaatttcaggtgtcagggattcatctgcttcaaatacaaagattgtgcttcatttggatcagggtggaaagaatgaattgtatacatggttttttggcggattattggaagaagcacccaatcttgattttgatgtgttcggactatcatattatccgatgtggcacggaacaatggaagggttgcaatataatttaaactatcttgcaacaacatatgataaagaagtatgtgttgtagaaactgcatatgcatggaccacggaagatggcgatggtgtaggaaatgtttttatcagcggagatgaagaaaccggcggatacccggcaacagtggaaggacagtttcagtttatgaatgatttagagtcggttatattgaatgttccgaatgataaaggcattggatatttttattgggagccggaatgggttccggtggaaggcggtacatatgcttcttcagcgggagttgcatataagaacgatactgttacgccaagtaatacatgggataatatgacgctttttaactttaatggaaatgctttggaatctattaaggttttgaatcagccaagtgaaaatctgctgacaaacatcaactttgagcagaatgaagtaacaacttcaccgagtggatggaatgtgtggctgagcgatacaactgattcgaatacggtcaagacagaatatggaagcgcttatgacggtaattataaattaacattttgggatgatgcggattattcctgctcgatatataaaacatttacaaacattccaaatggaacttatcaattctctgtttgggcgatgactaacggggatcaggatgttttgcagctttatgctaaaaattatggtggagatgaacttaataccacgatagaaacaagtgatattaactggaatattttcagtatagatgaaattgttgtgacaaacaatacattggaaataggtgtttattccgttgctggtgctgatgactggtgtaacctggatatggctatattaagaaaagtagagtaaaactattgtattttttgctgcgaagaagaaaaaggaagaaacataataattaagacataaataaaaaagaaggaaacctgctgataccgcagtgtgttggcaggttttcaaaaaatgacagaatgttgagatgagtgatgaatcggggggtttattactctcttttcatgttagagagaaagttgcgacgcgacataattacagacgcgatacaatctgtttgcggacgctttgcgttgctatcattaacgtaaagcgaggtgaacagcatgaatatggagaaaaacagaaaaaagagttaaacatacggatcgggcaaaggttgaaaactgttagggaaaacagtggatatacacaggaaacatttggaatatcgttttgataatattgatttggattaaaaaaatgtgtatgagtttatgcaggcaatttttaatttttgtgatgggtgtgattgtgaatttgaagcagttgcagattgggaatctgatatgatgcaggaaatggcacagtatcaggattggtattaagggagaatgatgatggcagagaagattagaaaacttgcgaattcagaagttgaagtgttatctagaatagttgcagaatgcatgacaggaagccaaatgaacgaaatttttcgggaatgcggagtcagggacacaagcaatgaaagtacaaaatggaaaagaatctactacacttttttaacgagacaagaaatagacggagcatcaaatgcttttcttaattttattaaaaagagcttaaaaccggtaaggttcattaacggtcaaaatggtgattatgatgagattttattagagataaataaaccattgatgttaatcgggctacagatgacaaatgagagaaagctgttaaagatagaggcagcaaccacaatatcggaggtcgaaagacggacaagagatttggtaagcgagttacaaaaaagacatattcatcaggatgtaataaagtgctgtaaagaagaatacttacaggagaactattttcatgcaatctttgaagctgcaaagagtttgtcagagaaggtaagagaaaagacagggatgcaggatgacgactccaatttatttaataatgcttttgtagttaataatcccagactggcaataaattcattgcagacaccttcggaaaggaatgcacaaaatgggttaaaagagatgttaaacggaattacacatatggtaaggaatgtgacggcacatgaactgaagataaagtggattgtgaatgagcaggacgcaattgatattttgacaacaatttcctttttacataaatagttggacgagtgttttgttgttccacagcatataatataattaggaaaaaacaattgttgtgagcattaggatatgctatactaggaatgagaagaaagggtgtgattgtatgttggcaacgaaaccgcaggtagtagcagaaacatcagatactgcaaaattggaattatatagattgattggtgaaggctataaagcaatgcaggaaggcagaaccagtacgattgatgaagtgagagaaaaactgaagaagaggagagaagagcgtggctaatgtagtatttaccgaaccggcagaatatgatttgctggatatagagtactatatttttgtcgatctttgtaatcctcaagcatcaagaagaataacggaaggtattctcgaagctgcagaaaggctgggagaatatccgatagggcatcctttagtagatgatgaacttttgggaagaataggtttgcggatgacgcgctttgataattacaatatcttttaccattatgacagcgaggatgatgtagtgtacataatcagaattttatataacaaagttgattggcagaatatattgaaaaagtaaacgaaaattgttggaatcaaacctctaagtcttcaaagatttggaggttttttcttcctgttttcgctggaaaataatttccgaaatagacagtctatggtacaattattgtgaaaaacaacagagaaggtgccaatatgggatacgatgcatatgtgcatataaagaagaaatacactaagttagccattgaaaaactattgatgctgatggattatgaaaaaagaggggattctttttattgtggtaatgatgatgactataagttttttactggtgttcatgtctggttgtgcgacgaaaatgaggaagaatgggtatacagagttagaagtcagtactttgcagtaggatatgatctgcagaagatgaatgaaacgattaggtgtctaaaacaatattgtgatgcctcgtttgaaagtgattatgggaagaatagatattttccagaggctactcttatcaaaggtgcagaaagcggatgctattttgcagtggagaggttatttaataatttcagcagtttaaagcatactttgagtaagtatcctagtgatgtagaagcagagaaatcaatgtatgaaataagtggaattcccactccaaacatgtttaatgcaaatgtgtattcgacttatttatgttctttaattgaagaatatttcagaacaacatacattgcattgctgaaatattctgaccggaaagaaaaaatattaaatgttaaattttcaccatatgatatggtggatataagtaatggagagaagaccgtagaagaagtttttgcaagtacattatcatttcagaatatacaaaaaatttgttcaaattttcatgctttagataataagctagatataggacaagcattgaagaaaccttatcataatagaaaaaagaatctgtatgaacaggtcaatgatattttggagcgaagacatggtctaatacatcgactggaaatagatgatagctattgtactgaaagcttacaaaaagatatacaggatgtgattgttgcaattagaagggtatactcttatctttgtaaatattataactgggaggaacaagaagtgagtttgtaagacagttattttcataaaaaagaattacaaggttttggttgtgtatactggaaattgaggtgtaaaagtgaaagcatttatgtcttataataatttagctattaataatgcgaatttcaatctggaagggaaattagcaacattatggtttgataatttgctgttaggaacaggcaaagagcttgttgagaaggttatggaagatgtagcagaaaaggaacaatggagtagtgatacttttaaggaaatgaagaaggtacaaatatcttcagaaaccctacttccttcgattagttttatggacgaatcaataattgaagatgattattttaaagatgctgctgatgttttgaaggataaatatgcaaaggaattatcaagtcctaaaacttacggtggcgccatgcatgaaatagtatgggaaggttttggaatagcgaattctgttaaatattggaccttgcttaatgcaaaagcgaattgtacttttttgccaatggatatggaacagcagatgttgggaaaagtttttggaagtacaacagatatgggatatagtaattttagcgatattattacagcaataatacctgatatttctgagtactcatgggatgaaattatagagataaggcatcacaactattggacacagtttagaaaaaaacttacagagttgagtgaaagcattgaagacaaaaagctaggacaagatattctggaggaaatagtaagaaaagatttaattgaaatggcacaacgttttagacctcaagtgactaagaatattgtaaaaggggttgtgagtaatattccattgccaattccaattaatccagtatcagtggtgtgtacaggatatgatataatgaaggagatagattttgataaaaaatatggatggatatatttttatttggacaataagaagtagaaaaaaattagataatgaataagtacaagactattgtctcagttactagtaagtgagaaaacaaatggttggaatcaagcctctaagtcacatatgatttgggagctttcttctgcccattttgattttggaaaatctatccgaaaaaaaactatggtacaattacaggtagcaatgtgtgccatagaaaagagcagacttcaaatcaaaccgaagccaatcaaagtctcgtctatgaaatcaattctaatcttttctgtggcaggtgcatcaaggtgcagtatgccgtttgtgcagacccgatatgggatcattgcatcatttttgaatccaaggcttaacggaaagccaagggttgtgcatctaaattgcacgctcagataataatgttgaaatactcaatttatcttcattttcattaaaagaaaaaattgataagctaattagtaatgaaggtagattatatattgggcaagatatgttagttggaccgaatggttacgatttttctggtaaaggaaccttaaatgtaatgggagcaaataagcaaccatatcgaaatgttgcagttccaatgcaaggaacatcgacaggtaatgctaaagaacttgtgggttatttttggaaacattttggtgaaacggattgggttgctgtaagtaatgggggaggttactgcagatggcagggattaaatgatagtgtagtcaaatggggaaaggaaggagagtacattaagtctcaaaaggggtctgcgttaagaaatgtaaaatattttggtgatactcaaatgctatttagtgatacaggaacagcagggttaaatgttagagttttgctggataatcagatttttattgcgtctggtccaggaattagagttgttgaaggaaacgaatatgcacatttagctttcttgaattcaagaatagcggcatattatgtgagaatgatgtctccaaaacttacaatagcgggcggatatattggacaaattcctgttaatgataatatttattcttcagttgttcttgaaaaagaagcacggttatgtgttgagctaaaaaggaaaatgttatcgacaagacctaataatatagagtatgagtccacatatatacaaaatattagtggtaacttgcttaatgatgcttgcctaagaaggaaatgctacacatactagcattatttaattcagtagtatttgattatattgtaagattaaaaatggcggggcttgatttgacgcagacaattattaaacagattcctattccggatacaaaatcatttgaaaaagagttggtctatatgggagaaaaagcaacaattgaaaagcatattaattctcgaataagaatgttatacgcaagcaaccaaagactggataacttatttgcggatgtgagtatctagccgataaagagaaaaatttctagaaaacaaataatagcagaaatagatagattagtagcactcttgtatggattaaatgaagaaacatttgagaacatacttcatacttttagtaagtactattcagaaaaggaagttgaagcttatttttaggcatcaacgggagcatcccaaagtttgtgtaaacctccaaactgatgtaagataaaattactcagtttgcatgcctgtaaggagaaaaagatggatgtaatggttttgatcgattcgtttaaggggagtatgacttccatggaagcggggaatgcggcgcgtgacggggtgttgcgcgtctatccgcatgccaatgtgacggtccgccccctggcagacggaggagagggcacaacagatgccctgatagaggggctgggcggaaggaaagtggaactgtctgtgacgggaccgatgggaagccgggtaaaagcttactacggaatccttgcggatgaaaagacggtggttatggagatggcgcaggccgcgggcattacgcttgtggaggaagcgcagagaaatccgggaaaagccaccacctatggagtgggcgagatgatacgggatgccgtttcgcgcggataccgcaaattcatcatcggaatcggcggaagcgcaacaaatgacggcggaatcggaatgcttagagcgctcggtgtgaagtttctgaccaaagatggagaggaagcaggagagggagcggatgcgcttggtaaaatacatttcgtttcactggagcatctgatgccggaactgaaagaatgtgattttcagattgcatgtgatgtcacgaatccgctctgcggagaaaaaggggcgacctatatttatggaaagcagaagggcatacgggaagaggaaatgccgcgtatcgacgcggatatgaagcattacgccgcgatcactgccgagcggatcggcgttgactatgcagcccgggagggcgcgggggcagccggcggcatgggatatgcctttatcagttatcttggggcgagactggttccgggaatcgagctgatattagacgtgatccattttgaggaggaggcaaagaaagcgcagattgtgctcaccggagagggacggctggatcttcagactgcaatgggaaaagcgcccgtgggggttgcgagggctgccaagaagtatggctgtaaagtgattgcgttcgccggttcggtcacaaaagaagcaactgcgtgcaatgacaacggcatcgacgcatttttcccgatcgtgcgcggggtgtgcacgttagaggaggccatgcagcgggaaaaagccatggagaatcttactgattccgtggaacaggtatttcgtctgctataatatcaactactctacaggatgatttagaagaacgattatctcaaaaatctggaatgaaagagcaggtgatacgggaaatagatctggataaacggttcaaaaagaaatgttggggcaatcaggttctcccctcaccccttacagtgctccccgcggtatgccgtcggtgacatgccggtctccttctgaaagctggagaaaaagaaactgcggctgccgaaggacagttcatcgctgatgtcctgaatactcatgcgggtacccgatagaagaagctttgcttcttctattttttttcggcggatataagcattcacgctctcgccggtcacttccttgaacttgtgggaaaaataatattccgtgtagccgagccgttcggagagcagagagatcgagagcggttcgcggatgtgcagactgatgtagtcgcagatgttctgaatctgcctggaatgtgcattcgtctcctttgcggcgcggacacggtggacgtaatcatcgagaaattcgcggcttaaattggtcgtgtcggcagtcgttttacattcctcgatgcgcccggcatagtaatcgtttagggtgtatgcgatggagggattcagaccgccatcgatcgcagcgcggctgcacagggttaggagcaccagcagattatttttgctcatgcggagtgaatcgccgatctcggccttgacgccggagcttaaggtcatggattttgcaagagcctttttgtattccggatttccctcgcggatcatggagagaaatgtctgttccgccatccagatgcccggatgctccccggagagaagcggcgagtcatccggaacgcttgtcgtgctgtgtgaggtaaaagagatcagatccgcggtgatccgctcgccggtaatggcgcagtgaaacatgatggcgtaggagagcagcacggaagacggaatgatcggcacactctcgatctgctttacaattttagagcgcagcttgacggtaagctggtaggaatccagctttttacgcagaaccagatgcgagttgcttccggtaaaagcaggaccgacgatgtggatctgctgcagcgcaaagccctgatactcaaaaccggcgatccagagaagtccgaactcggtgtccaaaatcagcggcatgcggttcccggattcgatatgtgcgagtacgagagaggaaaaacccagcatggagataatgtccggcagcatgagttctgccggacagtctgtctcgatcagctcaaactccgggctgtagtgccagagatgaagcgggtattcacattgaaccatttcctgaaaaaaagagagacgttctttgatgtccatgtgggtattcctttctttagcggttccagcttccgaggaaacgcaggctttccttcggatgtcttgtctgtgtgctgcggtcgaccgcaatcagtccaaaagtcatcgagtagcctttctgccattcaaaattatcaaggagactccagtgaaaataactttttaccgggagaccatcgcggatgcaggcagcgacgccgttaagtgcggcatcgataaaagcgacgcgcctggtgtcatcggaagttgcaattccgttttcagtgacatacaggtcaccgtgaaaatcttctgccaccctgcgcagaacatgctctaaagcttccgggtaaaactcataattcatctgggtcagttcggcaccctccggattcggaagctgaccgtccggaccgatcagggagcgggtataattctgcacgcctaagaaatcatcctccttaatataagggagatagtgtaaaaattcttcatcccactcagaggctgcgcgcgcctcgccgcccgcctgcggctgaatgtcgtgcaggcttaaggtcagaccgactttaatgtccggatagagcgctttgatttcttttctggcgagctcatgtgctttcatgatgagaagatcgccctctctggtgcgcatggaggtaaagttttctactttttccacgccgaagacttccatattttcaagggcggttgccttttgattttccatcattttctcaagattgatgccgacctgcaccgtaccgtccgcgctgtcgccgctccttggcgctgtctgtgctgcctgcatctgcgccatcatctgccgcttgtagcgctcggcgattgcggcgacctgaatgcccatatttgcctcgttgatggtgcatacatagtgcagttcgctgccgagttcttccataatataatgaacatagcgggcaaagtcggcaggcgtagtcgaagcttcccatccgcctttggtcatcagccatttcgggctggaaaaatgatgcagggtaacaaacggttccacaccgtattttttgcagcaggcgatgacgtcgtggtaatatgcgacggcccctgcatcaaacacgccctcctccggctcgatgcgcgcccattcgatcgaaaaacgataggcgtttaagccggcgtcggacagaagcttaatatcttcctcatagcggtggtagtgatcgaccgcgtctaaggacggctccaaaaagctggtgtgcttcatgtgctccatcgcccataagtcgctgcggatgttgttcccttctacctgatgggcggctgtggcagccccgatcaaaaaatgttccggtaatctcataaaatcctccattctgcagtgaaaaaatacagcgtcagccgtatttttcctgtgcatctcttgtaatctgatgttactatataagattttataaaacccggagtttacaaaatcgtgaaaatgttagaaaaatagcaatacatcattttataacatgaattttagtacataacaacgaatttgtaaacacagaaaggaaaaagaccggctagaataaagccatagaaaacagaggccgcagatatagcagacatacggaagcggcaaaatacggaaaagtctggagggtataaaaatgtttggaaagaaaaaagaacagtctgtggagacaaacggcattgtctaccgccgtgcaaagacatggagggtagcgcttgcaggatgcagttctgggattggaatgtgtttttatgtgctgcttggactggcaagctatgtggcaaacgaagggtatggcattgcaacagcggtggtaggcattatcctgactgcaacaagaatcttggacggcgtcacagatccgatcattgcgatcatcatcgataagatgaacacgcggtttggaaagatcaggattctgatggtggcaggatggctgatcgagtcactggcagtcctgatcatgtactgctgggcgagtggaaagggacatggaatcgtgctgttcgtgctgctctactgcctgtatgtgatcggctatacgatgtgcaacgtcacagcgcagatcgttccggcgatgcttacgaacgacccgaagcagcgcccgatggtaggcgtctggagtacagcttataactatctggtgccgatgattcttaacatcgtgattacggtgatattgctcccaaaatatggaaatgtctattcggtagagatgcttgcagcatcctgcatcgtctgcgtggcagtatcgggtgtgggattacttctctgcagcatcgcggtatcggatatcgataaaccggaaaattttgtgggcgtggcgagcaagaagaaggcggagccggtaaaagtaaaagatatgtgggagctggtcaaatccaaccgtgcgttgcagacgttcatcgttgcggcaagttcggataagatcgcgagccagacggcaagccaggcggttgtgacgacgatgctgttcggaattattatcggcaatatgcagcttgggacaatcttaagtgtaatcggtatgcttccttcgatcatcttcgcgtttatcggggcgaaatacgcaggaaagcacggaaataaagaggcgatggtgacgtggacgtatgtgtgcatcaccgtggcggcggtgcttgtggtattgtttattttcattgatccgaccctgattgcgacgacgcttcctatgatgattgtatatgtattattgaccctggtgttaaatggtgcaaaaatgtgcgtgacgatgtcaagcaatgcgatgatggcggacatcattgattacgagttagaccgcagtggtaaattcattccggcagcagtgacaggtacatacagctttattgacaagttagtatcctcgttttctgcagcgattgcaaccggtctggtggcattgatcggctacaggcacacgatgccacagccgaccgacccgtccacaccggcaatcttctggatgacgatgagcatgtatttcggactcccgctgattggctgggtatgtacgctctgcgcaatgcgcgagacgccgctctccaaagagaagatggaggaagtacagaagagcattcaggagaaaaaacaggcagaagtggaaaaagtgattgaggaaatgaaatagagagaagaaaagagagggaaaacggaatagatgagaaatacaatagtgctggaaaaagactggacattttataaaaatccacagagtgaaagcggggaagcggtgacgctcccgcacacctggaacgcggttgacgggcaggacggcggaaacgattattatcgcggaacctgcaaatatgtgcgtcattttgcaaaaccggaactggaaaagggaggaagagcgtatctggaatttaacggcgcagcgatgacggcggatgttgtggtcaacggaacgaagctgttccaccacgagggcggattttctacattccgggtagatgtgacggagcagttgacagaggacaatctgttagaagtatatgtggataactctgacaacacaaaggtgtatccgcagaaagccgattttactttttacggcgggctgtaccgcatggtaaagctggtgacggtgcctaaagtgcattttgtgatggactatgcaggcggaaacggcatgaaagtgacgccggaggtgacgattctggacgctgcagagaaacaggcggacgcagacgtgacggtggaactgtggatgacgggggaagcaccggacgtgacggtcaccgtggcgggagagacacagacggttcccgtggaaaacggttatgcaaaagccgtgtttgcgcttaaaaatgtgcatctctgggacggtgtggaggatccgtatctgtatacggtaaaagcagaacttccgggcggtgatgtcgtggagcggacgtttggctgccgcagctttaagatagatcccaaagagggctttttcttaaacggacgatcttatccgctacgcggcgtgagccgtcatcaggatcgtgcgggcgcgggcaatgcgctgacatacgagatgcaccgggaggatatggcgattgtaagagagcttggtgccaacacgatccgcctggcacattatcagcacgcgcaggagttctacgatctctgcgatgagaacggaatcattgtgtgggcggaaattccgtatatcacgatgcacatgacagacggcaccgaaaatacgttaagccagatgaaggagctgatcgtgcagaactatcatcatccgtcgattgtctgctggggactttccaatgagatcacggcagcaagcgcggtgaacgaagaactgctggagaatcaccgtagattaaatgatctgtgtcatgaactggataagacgcgtccgacggttatggcggatgtctttatgttagagacggacagcccgatgctggagataccggatatgaacagctacaatctctactttggctggtacatcggggaactggaacagaacgacagcttttttgacgaatatcacagcacttaccccgaccgggtgatcggactctccgaatacggcgcggacgcgaatccggcgtaccacagtgcgaatccggagcggggcgattacacggaggaatatcagtgcgtttaccacgagcatatggcaaaaatgattgaggagcgcccgtatctgtgggcaacgcatgtatggaatctgtttgatttcgctgcggacgggcgcgacgagggtggcaagcacggcgagaaccagaaagggcttgtgacgatggatcgcaggatcaaaaaggatgcgttctatgtatacaaggcatactggagcaaagccccatttgtgcatctctgcggcagcaggtacacggaccgtgcagaggatgtgacggagatcaaagtgtactccaaccagaagaaggtctcgctctttgtggacggagcagagaaagagacgaaagaaggtgcacgcatcttcagattccgggtgccgattacgggaacgcacacgatccgggtagtgtccggggactgcaccgatgagattacagtgagaaaagtggacacaccgaatccggattacattttcaacaagcagggcgacgtggtcaactggtttgacaaagaggattttaaagccgatcactattcgatttccgatacactgggggaactggcgaaaaatgagatggcaaacgccattgtgcagagcctgatggcacaggcttccgcaagccgcggcgatgtggcggagagcgtgaaggacaacccggcattgcagcggatgatgcagcgcatgacactggcaagtctcttaaagcaggcgggagacgctgtgagcgaggagcagatgaaagcgttaaacgacgcattgcagaaaattccaaagaactagggaacacgaagtaaggagcgcagaggaatgaaaaaagcagtacagcagatcatgcttggaacagtaacgaaaaatgaaaagcagacggcagagacgctgcggcggatcagggcggcaggctacgacggaatcgaactgaacggttttatggtgaagccgacctcttttctggtgcggatgctcacgaaggcggcaggaatgccggtcggaaaaggcggaagctatgattggaatgcactcgtaaaagaagcgggactttgtgtgacgagcatccatgaagatcttggaacgatcagacgggagccggagacggttgcaaaagaggcagaagccttcggcacaaaatatgtcgtcatcacgggaatgtaccgctttgattactcggataaagccgcggtgcaggggctgtgccgggatctgaatacctccggaaaaattttgaaagaggcgggcattgaacttttataccacaaccataactgtgagttcctgcacgttgagccgcagaaaacggcgtatgatctgctcctttcggagacagatccggaatatgtcaactttgagctggactcctactggccgacggaggcgggcgtggatgcgctcgccctgatgaaaaaactggacacgagaatgaagctttatcatatcaatgaccgcggcactcgtcttttgaagcctgccatgacgccgatcttaaaatcggacagcatggagcttggctgcggcaatatgaatctggatgcactcattgcacaggcaaagaacgtgaatgtggatgccgtgattttagaaagccataaaaactgggtggataactctccgctgcggtcgctggaggtaagcgcacagtttttaaacgcacggatctgacagagcgggagatggcagaataaggatggaaatgcagatggaagaattaagaaaacagtggatcacttcagaaaaagaataccgggagggcgaggtttttgtataccggcagaaatttacggcttcacaggtcaaaaaagctgtgttttacggcacagccctcggcgtgtacgaagcagaattaaacggcacgaagatcgggagccagatgtttgcaccgggattttcctactatccgagacgtgtgctctatcagacacacgaggttacggagctgttgcgggaaggagaaaatacgctgacggtctatctcggacaggggtggtactgcgggcgttttctctgcgaaaatcagacacagatatacggagagcagccggcggttgcatggattctggaactggaggatgcggcaggaagccgaaggattgtctccgacgagacggtggaggaactggaatccccgtatgaatatgccggagagtacgatggtgagatttattttgcagacggaagagagaacgtgaccggtcatgcgtccgcctacacaaaggaggcgccgttcgcactggagccgacgcttacggaagtgcgtctgcaggatgagatgccggtgcgggaggcaacggtgcatggagatgtgacgatccttgatttcgggcaaaactttgccggaattgtagaaatagatccttcttttttgaaaaatgagacaattacgatccggcacggggagatcttaaatgccgacggcagcctgtacaccgcaaatctgcgcaaagcgaaggcgacgattgtctaccatgcaggtgcggagaagaaaaaataccgcccgcgctttacttatatgggatttcgttatatggaactttccggtgcggcatatcagccggggatgatcagggcatacgcacttcacacagagatgaagcgtaccggatatttttcctgtgaaaatccgctggtgcagaaactctatgagaaccaggtctggggacagaaatccaactatgtggaagtgccgaccgactgcccgcaacgggatgagcgcatgggttataccggggacgggcaggtatttgcgctgacaggggcttataatttcaatacggatgcgttctggaaaaattttcttcgcgatctggagctggggcagcttgacaacaccgagggatatgtgtgcgccacggtgccgcagacgggacctgccgggatcggatttatcagtatgctgggatggggcaatgcggtcacgattctgccggagatgatgtaccgtcagttcggggacgaggaggcactgccgcgccagtatgagagcatgaagcttttcgtggaggcggagatccgcaagatggggaagaaaaatctctggatcggtccgtcattaggcgactggcttgcgatgggaaaaggaatcgcatggcaggcgatgcacaacaatccggtgtcaaacgcgttcatcgtgcatgatttaaaggtcatcagcgagacggcagaacggcttggaaagcgagaagatgcggcgcggtaccgcagacagcttgccgcgacgacggacgcttatatcaaaaaatttgtgagcaaaaacggaatcgtggcgaaggattatcagtccgcttacatcatggcattaaaatatgtgctgccggagggcgagctgcgggaacgggtcaagaaaaactttgttgccaacatccgtaaaaacgggctgcagacgggattttttgcgacggagcatttactgccgcttctggtggaggcgggagagcagaaacttgcctatgatgtattactgcaggagaactgtccggggtggatgtaccaggtgaaatgtggcgcgacgacaacctgggagcgctgggatgccctaaagccggacggaaccgtcaacgaggagaaaatggcgggctccggtgaaaatatggtatcctttaaccattacgcattcggcagtgtcggggagttttactatcaatatatccttggaatcagaccggaaaagccgggctttgcaaaactgcattttgcaccttatccggacgagcgcctgggaggcgtatccggaagctatctttccgtggcagggaagatcgagagcgcatggcggtacgaagcggacggctgtcatatccggcttgcaacgccggtggaggcggtcgtgctccttccggatggaagaagtgagaatgtgcctgccggaacgtacgagtggacggtgaaaagaccgaatctgtaaaaagtgcaggatatgtaaaaaaaatccggaatctgcctgaaaaagggcaagaaaggaaattgacggcggcaagacatagatgataaaatctcatgagatatacatgtaaaggatgaaaattatgtttgcgaaaatcaatttccacgatgaattctaccagaaattaaagcttctggtgctgccgatcacgatgcagcagtttatgctggcgctagtcagcgccacagatgccattatgcttggggcggtcagccagacctccctgtcagcggtgtctctggcagggcagatccagtttgtcttaaatctgtttatcagcggtatctccgccggctccggaatcatggcagcgcagtattgggggaaaaaggacgcggcttccattgaggaggtcatgccgattgcactgcgcaccaatctcatattcagcggtgcgttcaccgtgtttgcggcggtggcacccgaggtgctcatgcgcatttttacgtccgatcctgcgttaattgagagcggagcggtctatctgcgcgcggtgtccctgtcatatctgctgtgcggtatttcacagatttacctgattttgctgaaaaataccggctatgccacggtcagttcacggatcagctgtacagcggtcgttgtgaatattatctgcaatgcgatcttgatctacgggctgttggggcttcctgcgttaggaatacagggagcggcttacgcgacggttgccgcccgtctggtggagctcgtttggagttatctggagacgaagcagtccgggcgtgtgcagatcatctggaagaaaatgttccatgcggcggatgccgttctgacaaaagatttctggcgttataccatgccggtgctcggcgctgcactcgtctggggaatcgcctacgtgtcctactctgtgattatgggacacatgggaagcgacgcggtggcggcaaactccatcaccacgatcgccaagaatatgctatcgtgcctgatccgcggcgtcagcggcggcgcgggcgtgctgatcggaaacctgctgggcgccggagagctggacaaggcaaaagtgtacggcggcaggctgacgcgcatggcaatcgtggtcggcatgaccacaggcggtcttctgatgctgatctcgcctttgatcgtgcgttttgcaccgctcagtgagacggcggcggagtatctgcagtacatgctgatcttttgtggctgcaatatcatggcgcagtcggtcaacacgacagtgctggacggcatcttctgtgccggtggggattccaagttcgacatgaaggggaatctcggggcgatgtggtgcttttccgtaccgtttggcttctttgcggcattcgtgctgaaatggccggtcatggtggtgtactgtatcgtgaacctcgacgagattgtgaagattcctgctgtgtacttacattataaaaaatatatctgggtgcggaatattacggtacaggaagacgcttgacaaggtgcttttagccctccgggcaggatgcacacttgcgcgaaggagagacatgccgcaggcgaccgcacttggtgcgaaaatgtgtcgtggcatattttttattgcagaaaacgtttgtgagaaagcctggagaaggctggcgcgggtctacagaggaaaaatagctgcgtgagaccccaaaaccgcttgataagagagaaaaagagggataaatccatggcttttgggcactggaagcaaaaaatacgccgtgagacccggaaattgtaaaattccgggtctcacggcgtattttatcggctgtagacccgagaacgctccagcagatagaaaaaatgatcaaaatattccagaaaacgggtctcacggcgtattttatcggctgtagacccgaagtttcagaatacagagcagccggaataaatacaaccatggtacagaaagttgcatgaatccgccgggagattatgaaatgcagaaagacattatttatagtgtatgactgtatgcagatttgacgagcaccgtgaatctccgggcggtttgcgtggaaagaattccttgcaaaagcgcgggtgctgtaataccataaatacatgatgggttgtagaaggagtagcttgtatgggtgaagatataacggtcagagagatcgggatttatttattaaaccgagtcgaagtgacgctgaaagatgacagcagggcggaaggcattctgcagaacatcacggcggagacgatcactgtagagggcagggagatcatgctttcggatgtggcggatatccggctggcaggggaactgacagattatgatgtgatgcgtgataccggaatgatcgggaattttacatttgcgccggaagcctgccgtgatgctgcggaactggaactcatgcggtatggagattttgcgtgtaccgtgtcctgccatctgaagcttgcatccggaaagatctgcgcggatgacatccggctggtatcgcacatacacaagatctgcgcggaaaaattaagccggacggcagcaatttacagcctttttgatggaacatttttagtcggcagattgcagcaggatggaaccgggatgctggagcagtcaggcggcggacaggttccggtcgattttgccggggtgaaggagattttcccgcttccggagaccaacgattcactgcatgtcaccatgaaggacgggagctgtcgggagggtgtcgtgtcggctgtgacggacaccatgttcgtattgatcggtgagggcgtgtccatgattccgtttgccgatatgcaggaaatccgctactgcgggaaagtggtgcgtgtgcgggaaccgggcagccgggggaagacggatacgtggaagatcgcagtcggaagccgggatgcagaagatggtttctggtgcagagtgccggaacattccggagcagcgcagatcgacgttggagatcaggtctcctttgtgccgggaattacggattgcgaatggatcgccaaggatgtccggctggtgaatgcggcaggaaaggaagaaccggcggaagcggggtatacaggaaggggaattattttatttttcccgaatgcactccggacgaacggctttatcgggaactgctatgtctcacagaattatgcgaagatggagaacgccggattgccgcgcggaaatgtcatgttttcacaggagcagattgactttggattcaaaccgggcaatatctacgtggtttcctacacctgcgccaaagaaccgggtgaggtggtgcaggaggcggtcagtgtgacgctggagaagatgtatccttatgcggattatgcgaaagtgtggattgacaggaacggcgaggtaaagatgctgccggtctctgttttttatgcgaagaagtttgtgggacaggacgtggaagtgctgctctcgaatggagagagaactgccggaaagctgaaggaatacacggatgaaaaactgacgcttcttgcgggagacgatggcgcagaagagacggttctgcagacggaagatatcgcgcaggtgcggtatgtgggactcattacggcttaccgcacggataacggtaccggttatatttccggggaatactggttccatgtcaataatctcacagatgccggtgaggcatcgcagctggttctggggcgcagggtttcatttacgcttgagcagactttaaagggcaagctttgcgcggcgaaggatgtcgctctgatctcagagaagactgtcattgcagaggagaagcaggaagaatccaaaccggagagactgcgcggttatatcgtaaaatacatgatcaagcagccggtcagtgcagggttcggttttattgtaccggaggaagaactggaagcccatctggaggacaaggagggaaccgtctatttcaagcagaccgacattgactgtgagacgatgccgaagctgaataccaaaagttattattacgaggttttatataccccgtataccctgcatggcaagacatgcgcgaaggatgtgaagatcggtgccggacatccgtatccggagaaaaagtcaaccgctccggtggcggtgaccgcagtgacaaaaaagattgtttcaaagacactgccgcttgtggaatatctggaaacggaggaggcgcgctatgtgggggcttctccgaaactcggaattatctctctctacaacggacactatgcgctgatcagcgactgctatatcaataaaaagcttgtgacagatcaggagtatgcaccggacggcgcgattgcgatcttcaatccggagcttgcacagatcgaaacggaagagacgataaagacagcaaagcactgttatctggtaaaatatgtgccgggcggcacaatggtaaatgaaaaaaccggcatggagcatccgtccgttgattataattatccggttctggtgttggcgtcctttgcgaagaaccagtatatctgtcttaaaattgaggcggatgcattgcaggtgcggaaagtggagcaggtaatgtccacgcttggcaccgccgtaccggaacaggtggattttgatattccggagctttgcagcggggagagtgtgatcttcgagatgacggattccacggcggcttaccacgtgatcgacagcgtgggggatgatttttaccgtgtaaaggacggaaaacagatcctgaaaaatgagattcagaagatctaccgtttcggtgttgtcacagactttaatatggaggaaggcattgcggtgatcaaccgtgtcatgaatttttccctgacgctggcagacccgaacgtcatcaatattttaaagagccagatgaacgtgacacgcctgcatgttattttcgcctgcgaggacaaccggatcacggaagtgcaccgcatatcggaagcttacagcggattgatccgctggcaggagggaacggtcacgcagtgcgatgaactgcaccgggcaatcgtggtggaccagaaggcaaaacactatatgtctgtgctctcggacggtatgatcaaccgggcatttaagagccatacgctcaccgggcagagagtatttgtaaaatgtgtgcaccatgtgtttgcggaggagggacagacggtgctgtctctggcagaatctgtgatagagatccggtgtcagagagagacggcaaccatccaatacgatgcggggcgtgatatttatctgggttaccgtaacgcgacgaaatattatccggtttacggtgcctcacagatactggcgggatatgtgaataaggaaacggcgattgtttttgcaccgggtgcggacggactggaactggaggcgcgacttgtggaggcaggaggagcacaggcacagccggaagctcagacggaggaattcgaggcggatgaagcttcggtcacgctggaaaatgcgatcggcgagaatctggcaaagttctgtatggaacaggtggatttaagccagctgctgttaaagggagtgaccttaaacgagcagagcatgccggaaaatagtgagaatgcacagagagcagtggatattcttcacggacagccgggggaactgcaatcctttgcggctgccaaaatcgcgcttgcctatccggaggtggagctggagcatggcgcggaagcgggtggaaaatatgacagagagaaccagatcggaagactgttgatcggcacattgcagaagaactgccgcaagatcggtctggacgccaatatggtattcggggagcagacgtattacctgtccgttctgctgcgttatccgctcagaaagagcaataagaaaaatgcagcgcaattctcgatgggcgactgtctctatcagctgtttttgcaggacttcggcacgagagagcagcttgccaactacttacagcaagggaagaccgcagaccgcggacaacttgagacgctgctgaaccagaattgcaggcagatgagtgaacttatctcccacatgatgctgctggatcagaagagtatggagaccgtctgcgccattttaaagaagaatacgacgctgaccaatgagctgcttcgatatgcggtgcagattgacgatatgatccgtacgaccagccttgcggaagcgctgcaggccttgcgggagcgctataagaaggacagaagccgcttttcggcaaacctgaccggaatcctctctggaagtaatatctctgcggatgtgagagaactgattttaaacatgcaggtgcgttttttaaagctggcgggaaaggatgacagagcgcgctttgaaaagctgcagagggcgtgcatgagcgtctgcgattacaccaatcagccgggattttcattacaggagcgcctgctgcgggatgcctaccgggagatccgcgaactggaggaagagatcaagaagcatccgagcagagaggcggtagagattctgtggatgtgtacggacggagcggatggcgccaacatttttgcaaaattgaaaaaagagatcgcacagctgctgaactccatgtatcaggatgagaagacccgcccgaagatctggtgcaagccgaaccaggaactgatcgagaacggacagaagacgttctggctgatcgtcgggaacggagcagcaaatatgaacctccagtcggcggacaacgtcgggattattttggaatcctacacagagggcgtggacgttccttctaaaatcgtgttggaacagaagcacctggctgccggggatcagatcccggtcgaggttgcgatcagcgtggaggaaggatatacaggaagcttaaatatcggctggtccgtggaatacgaatacacgaccgcatttctgaccggggaaaatgaccgcaacggcagtctgcagaaaaagacggttcgcgaggatgccggcaattatctggaactgcagtacggcaccggcaggatggaaggtaaggataccggtgcagagaatccgtatctggaaccgtcgcagggacaaccgctggaagacaataagatgttcttcgggcgcgaggaggagagccgcgagataagaagcagtatccttagaaccgtagacggagaggaacagttcattccgggaagtgcagtcattatccacggacagaaaaagagcggcaagaccagtctggtctatcagataaaaaattatatcaaggacaatgagaaactgcgccaaaaagcgatcatgctgaattttaataacattctggacgaaaccggcggcgtggaactgcttccttactttaagcggtcgttttatgccaatattctgtcccgctttgaaaatgagatctacgatcatcatccggatgtggtggagcttttaagacagaatcagcttgaaattccggatttgtttgatccggcaggcaatgagacgtgggcggcgctcttcgagagatttttccgggagtttttccggtatgatggcggggaacatgtgattctcctgtttatggatgaatttacgcttctatgtacgaccatcatgagcgagatacgcagagacaaagagaaaaatgagagcctggcggctatcccgaactttatcaagacattttcacagtatggttttattcaggtgatcatcggacatgaggcgatgatgcgggcatttgacagccttggcgtactcaaccacacggcggaatttgccaagtctgtggagattgcggcgctggatgaggaggcgtccgtccggctggtgaaggagccgatggaacgggcattcgggtatgacgtatacgacacggaacttggaagacgggcggtggagaagctattggatctgtcgggatgtaatccgacgtatctgatgcggctgtgcagccagatgtttgcttactttgtgagtgaccgctgtccgagatcacggattctcgtcagcgatgtggaagagatggtacggcagtttatcagagagctgctgctgacggattttgatatccttctggtggaagacggcgacagcgtggaagatccggaaagccgcaagacgtatcagtatctgaagagtgcggcgtttgccacggtgaaatcctttgatcagagaacgtccgacatgaaggagatcaaccggaaactcacagaagaacagggatatagcacggaggagatcgagcggaccaagaatctgcttgaggcacgccgtgtgatctccattacatccggcggaagagtgaagatcaataccggattgtttgtggaatttatgttacagaagaacggaggaagagaataatgggtgaattatatattgaacgaaaggaggtcagccagatactgaggaaaaaggtcttcttcgtggaggaaggagattatggcaagtgttattcgctgattggaccaaacggcatcggcaagacgacactgatccggcacctgagcgacgaactggagagggcggcaaagccgcacacctactattttaatacggtgctggaggcaggaacctcgttctggcagttttggacagtactgattctaaaattttctgataccatcggggaagaggagcttcgcgatgcacctgtgccaaatgacaggctggtggagaaaatcctcaaatcctatcagttctttgaagaaaatatcgggcatcaggatgacgtcgtctttaagatgaatgctacgagagaattgtcttcgttgtttgaatattatacaaagcttggaatccggatgattctgacaatcgatgaatttgaccgggcacaggcaatcttcaaggacgggcagtttttccagcgcttgtttggtctgacgccaaagggcgccaaccggctgaatctgtcgatcattacgatctccaggcggagcgtgagcacgatcgcgcatcatatgcaggaggggtcgaattttcaggatgcgtttccggcactggcactgaaaggtttttccaatgaggaattggaagagtattttaacttctacagggatatgccgtgcggtcttctggaggagaaggaaagacagcagatcctttgtctgtgcggacggtcgccggggctgctgatgcagatgcgggatgaaatcgagaatctggacgggagtcctgttgacatcggatggattttccgggagcggggagctttcatcaagacggcgtatgagcgtatgtgtacactcatgagaacagagtatgtgaatcagagcaagaccagaagcagcatgggcatcttcattgaaaagtttatcggccctgcatattccgaaaagcttaacgagtgggtggaaaagctgtatgactatggatttgtgacccgtgtggagaagtctgaaaaaaatgtgtttgaactggcgggtctcacggattaccgcgataagggagaactggtatatgagccgatctctccgtattttgttgattttgtgaaggattttgctgttttggatgaactggattcgctcgcagcaatgttagagcagacggagcggagcatccgcgacgtattgatgcgggcactcagtaaggaatactcggaagaatgggagacggtactcggtcaggatgtgcagcgaaaggatgattatctggaaaatctgcgccggattgcgaccgagaacgaggcggatcagagaaatattatcatctccaagctgaatgtgctcgcgtttaatgattactttcagattatccgcaaacactgggatattatgaaaaagtatttcagcctgtattcgtctcttgatgagttaaagcaggatatgtacagcttaaacaactgccgcaatacatccgcgcatctgaatctggagatattaaacgagtcgggacgccatgatttgcgcaagatttgtgaatttatactggaaaatttcaaatgtgcaggaggacagcggacggcagaggcattcggcactgcggcagaggcatccgctgagaagccgtcacagccggcgggcggtacgggagcctggcatgagtccatgatcggtcagacagtaacgctgacacagacggaggcaacgacgaccggtgtgctgcgcggcgtgatcgcgggcacttcacatggagcatcgctgtcgaaaaaatatcttcttggcagggggacaccggcgcgcatgctcgctggcaaagatcagaggatccgtcttacccgctgggatgaaaatgcacagaagttcaatgcggagctggtataaggagtgtggaaaaatgaactataagcggattacagaccttccaggtgtgcggattgcacgcgaggcgatggtggtcggagacgtgacgatcggggaggacagctgtgtgctgttttactccaccgtgcgtggggatgagggaaccatcacgatcggaagagagacaaacattcaggaaagctgtacgattcatgcgagcatcgagggcgatgtggtgattggtgacaatgtgaccatcgggcatcaggcggttgtccacggatgcacggtcggcgaccggacgctgatcgggatggcggcgacgatcctggatggagcggagattggctgtgactgtatcgtcggggcgggaagccttgtcacaaagcacacccgggtgccggatggatcgctggtgctcggaagcccggcgagggtcgtgcggcagctgacggaagcggagaaaaaagatatttaccgcaacagccgggaatatgtgaaggtggcgcgtgagatgcaggagcagggactgctcccgtaacaggcgcaataagcatatcgtgctttgctttgataagtaatattatcagaaagaagaccacatcgtgggatttcagaatttgtttctcagctttcggtattctctcggcgaatatcctttcaacttgtgaaaaagccgactgaaataaagctggttatcatatccgacaatcttagaaatctcattgatggaataagttgttgtttcaagtaacatctgagcattgttgatgcggattcccacaatgaattgcattggtgtagaaccggtatattttttgaaatttcggataaaccagctgacactcatgcctcgtgaggcagcataatcatcaatattgatattttgattgtagttttcactgaaaaaggtaacagcattatccatctcataatcaagatattcattttttaatatgtgctctcttgtcagttcccggtggaaactgatcagaagatgacgtagcaaaaggacaagcatttcctcataattgtcttgacagcgttggagctcgataatgatacgtttgaaaatttgttcatattcattagatgtacccacttgaaagacacgttctttatccggaaacccatattgacgtaagatatttttcacattgcttcctgtgaagtgaatccagtatacttctgtcttatcttctccgtaatattcatatttttggagttctttcggtctgtacagtacaatgttgccggctggaacaatcgtttcattatttacattatcaaaatgaaaatgcccacaaccagcagtgatatatataatctgataatccagacgaccccttggacggtaggtcggaagtttgggatgtctggaaagacggtaagtaccacagctaccgacaatcagcggacgacttttgtctttgaaatccatatgtgagtggttcaaataaccggtgttcaaatacataggacagcacctcttttcgtactttttatcattgtatcatttagtgcatattttgtctaatccaattcatagacatattttgcggattaggataagctatatatagcataactaaggaacgtaaacaaaaagtaaagtataaggtttgctttaggaaaacaaagaacaaaaaagtatatgtattggaggagagctatttatgatcgtaccacgttattatgaaaatctaagcgtactgcacgaaaacacaatgccagccagagcctattatattccggcatccagaagaatggataacttggtggaacacagagaagagtcagatcgtatgcagttattgaatggaacttggaaattccagtattttaacagcatctatgacattcaggattctttctttgagaagaattatgatacagaaaattttgatgagattcaggttccaagtgtatggcagatggctggatatgatacacaccagtatacaaacatccggtatccatttccgtttgatccaccatatgtgccacaggacattccgtgtggagcctatgtacatacttttgagtacagtagagatgagaaagcgccaaaatcttttttgaactttgaaggagtagacagttgcttttacgtatggatcaatggctcttacataggatacagccaggtttcgcatatgaccagtgagtttgatgttaccgatgtacttcaggatggaacgaatacggtggcagtgttggtaatgaagtggtgtgatggttcctatttggaagatcaggacaaattccgtatgagtggtattttccgggatgtgtacattttgaaacgcccaaaacaggcaatcagtgattatcatattaaaacaagaattgaggatatgcttgcgaaagtagaaattgaaatgaaattctactctccgttaaatgtaaaaatttcgattgaagatagaaacggagcagttgtagcactaggaagtattgctgaagaaggaacagctgtattagaaatcgcaagtccggaactttggaatacagaaaatccatatctgtataaactgattcttgaaacagaaaatgaagtaattgtggatcacattgcattaagaaagatagagattaaagaccaggtcatttatctaaatggacagaagattaaattccgtggagtcaatcgacatgattccgatccggttacgggatttacaatcagtctggaacagattacaaccgatcttacgttaatgaagcagcataattttaatgcgatccgttccagccactatccgaacgcaccatttttctatgaaatgtgtgacaagtatggattcatggtgatagatgaagcagatattgaagctcatggtccatttatgatttacagaaaagaagacaccgattacaatcggttcaagcgatggaatgagaagattgcagatgatccggtatgggaagaggcaatcgttgatcgcgtaaaactcatggtggaacgtgacaaaaaccgtttctgtattgtcatgtggtcaatgggaaatgagagtgcttatggctgcaactttgaaaaagcactggaatggacaaagaattatgatccagaccgcatcacacaatatgagagtgcaagataccgtaattatgatgaaacatatgattacagcaatctggatgtgtacagccggatgtacccagcgctttccgaaattcaggaatatctggataaagatggaagcaaacccttccttttggtagagtactgtcacagcatgggaaacggacctggagattttgaagattacttccagatgattcaggataatgataaaatgtgcggcggctttgtctgggaatggtgtgaccatgcgattgcccatggaactgctgagaatggaaagacaatctatgcttatgggggcgaccatggcgaagaaattcatgatggcaacttctgtatggatggattagtatatccggacagaacggtacatacaggacttttggaatacaagaatgtttatcgcccggcaagagttatttcctataacaaagaaagcggagaactggtgcttcataactacatggattttgatgacttgaaagattatgtgaagatcagttatgaactgacacaggatggtcttgtgatcagcaaaggcatacttccggagttttctgtggcaccacacggggaaggaaaaacaaacctgaagatcaatgttccagagaatgggaaatgttatttaaaacttatttatcatctgaaaaaagaattgccactgttggatgaagaccatattcttggatttgatgaaattgaggtaagtaaagaggatacaaaatgtaaacttgcagagaaatggaaaccaaaaacagtagtggactctgaattacaggtaaatgaaaatgatacacagattcatatcaaggggcgtgaatttgcttataccatagacaaacgtactgcactctttacagagatgaaattcgcagggcgggaatacttgaaccatccgatggaattaaatatttggagagctccaacagataacgatatgtacatcaagtctgaatggaagaaagcccactatgataaggcttacacaagagcctatacgacagaggttgtgcagggaaaacatggtgtgaagattacaagccatgcttccgttgtggcagagacagtacagaagattcttgatgtgacgattacatggaaaatagaagctgctggaaagattgatgtagatattgcagtaacaaaagacgatgaattcccggatcttccgagatttggtgtgaggatgttcctggataaaaaactttcagctgtaagatactttggaatgggaccacaggaaagttattgtgataaacatcaggctgcgagccacggtttgtaccgggcagatgtaggggatttacatgaggactatatccgtccacaggaaaatggaagccattatgattgtgaatatgtagagcttaacaacagccgatatggaattgtggcatccgcagaaaaggcattttcattcaatgcttcttattatacacaggaagaacttgagaagaaaacgcataattatgaattaatagaatcagatagtgtagtattctgtgttgactacgcattaaatggcattggttctaatagttgtggtccagttgtattggagcagtaccgatttgatgatgtattattccggtttcagtttacactgataccgtatgtaaaggggtaataaagtttcatgtaacccgtaaacaaggaaagagagtctgattgtaatgtaaagtccggatatacagagcaatcagacaaaaacgaaacaaaagaaaaatttagaattaggcatcttgagattctaagtgcaatgaatatgaggagcaaaagaattctatggaagaaaaaaagtatttgaaatggtataacaaaattggatacggatcaggtgatattgcaggtaatgtagtctatgcgttcctgacatcttttatgatggtctatctgacggactcggtaggacttgctgcaggtgtcgtgggtaccctgattgccgtataaaaactatttgatggttttacggatatattttttggatcaatgattgacaaaacacacagtaaaatgggaaaagcgaaaccctggatgctatacggatatattggttgtgccattacgctggtctgctgctttgcagtaccggtgagtttgggaacaacggctaaatatgcatggttctttatttcttatacactgttaaatggtgtgttttatacagcaaacaatattgcttattcagcacttacgtcactgattacaaagaacagcaaagagcgtgtacagatgggatcttaccgttttatttttgcattttcaacaagtcttctgattcaggcgattacagttggatttgtagataaatgtggtggagatgctgcggcatggagaacggttgctattatctatgcaatcattggtctggtcgtaaatacgatttcagcactttctgttaaggaacttccggaggaagaacttaatgaaggagaagtaaagaatgataatgaaaagtatggaatggtacaggcattcaagcttcttgtcaaaaacaaatattacatgatgatttgtggaacatatattttacagcagttatatggtgccatgattggagctggtatttattacatgacatgggtactgaaaaataagaatttgtttggacaatttgcatgggcagtaaatattccactgatcattgccctgattttcacaccgacattagttggtaagtggaaaggtatgtataaactgaacttaagaggctacgtcttagcagtcatcggtagagcacttgttgttgttgccggatatatgggcagtgttccgctgatgatggcatttacagctcttgcagccttaggtcagggaccatggcagggagatatgaatgcagttatcgcatcttgctctgaatacacttatcttacgcagggaaagagaattgacggaacgatgtactcttgtacttctcttggtgtaaaaattggtggaggtattggaaccgctgttgttggatggatgcttgagtttagtggatatgtcggaacaaatgcaactcagccacagtctgcacttgatatgatgcagttcatgtatctttggcttccgttaatctttgatgtattgattatgtttgtactttcaaaaatgaatgtagaagatgcaaataaaaaactgaaagcagaaaaaggaattgctgcagatgaagtaacagatgcattagacataaattagaattgacaggagaaagcgttgtctggtcgttgctcgatgggacagtgcttttttctatatataaagtgatagaactgtattttgaaaataaaaaaggaccacttcatttttgtgaaatggccttaagaaaatattcagttttcacaaaatagtccttttagtatttatacatggtaaggatgctcaaaatattcagtgtagaatactaaaaggtcattcagatatttttttaggttgctcatttgcaattcctcctttccttatttacaagttgattataagataggtgtaaaaggattgcttgccaaatcgaaagaagatatagacaaatgttgcaaaggggagtatttcatgcagttaaaatatgttgacacaaaagaggagattatagcaataaataggaagtcaaaacatattgaaccacatcttcataatgcactggagatcgtttgtgtaacaagtggatcattagaacttggtgtcggacaggaactataccatatggaaaaaggagatataggctttgtatttccagatgttattcatcactatcaggtactgacacccggtgtaaataaagcgacttatctgattgcatcgccatttacgatagccaaatttgcagatatcatgcaatccatggctcctgaatacccaatcatcaaagcggaaaaggttgaaccggaggtatatagggttataaatgcaattttagagacagaacagtcggatattactgttgcacaggcatattttcaaattgtgttggcacgctgcataggaaaattaaacttggtagaaaagagcagtgtggggagcaacgatcttatttaccagacagtttcctatatatcagcaaatttcaagaagaagttttcgttggaagagatggcaaaagacctgggcgtgagcaaatatgttttatccagactcttttccaagacatttcatagaaactttaatcaatatcttaacgatgcaaggctgaactatgcatgccatcgtttggaaaatacgagtgattctattacaaatatttgtctggatagtggatttgaaagtcagagaacgtttaaccgagtatttaaagaaagatataaaatatcaccaagtgattatcgaagtacctgtgtgaaagagatgttgtcataaaaggttctgttgatcgaaatatttactttgattttacagtgctatgtatttgatttcatgtgtggatgatataatgaatcatatcggattcatattggaagttcctgcggaacttcagatgcgcagaaagcagcgcaaaaagatgatataatacattttttaagacgggaaatgcttgattttacagcatttccagacgaatattccacctgcatttccacatgaaatctccaagtgtgtttctaataatattacttatcactcaaaagcagtctatgcttattgcgacaattcttttgatccttgacaagatgcctgatgtcgtatatgatacagatagttagaggagactaactcaaaagatcgttgatacaggagggatcggcatgagtcgtgagacatgggagattttgcagcagatggagccaaaagatgtggaattgcagcttgcactgcagtgtgcgccgttaatcgcaggcttaaagccgtcgaatctgttcaatattccgtgtgagggagtatgtcaggttcgggagctgatccgggataccggaatatccatgtatgtgcttttttcaaccggcagaaaagcggctgtgctcttataccgaagagaaagcctggaagaatacatggaacaggaacaggtgaaaaggatgctgcataaactgggatatcaggatacttccttggaggcggtgcttcctgttttccggatgcgttaccgcaggtacatgcaggagcgcagggatttccctcatgagatgggactgcttttgggttatccggtggaggatgtgagagggtttatcgagcatcagggaagagattatctctgcaccgggtactggaaggtatatgagaacctggaacagaagcagcagctattccagcggtttgagtacgcgaaagaaaatctggtactgctgctttcctacggagtgggaatggcggatattatggatatcttcggcgggaccggacaaaagacgctgtaccaggaatgtgcaggttagaagtgatgggaggacactgaagaagattcagtgtccgtttttgtatcatggaaatttttttttgccgcacattttgcgccggaactggcgggaggcttgacaaataggaagtgattgataaaataaggttagtaaaagctaactgaaaaggaggcttgcaaatgaactggagtgtattttacggaatattgataccgtttcttggaacatcgttcggcgcggcgtgcgtgttttttatgaaaaaggagatgggagaccggctgcagcgtatgctgacgggatttgccgcaggcgtgatggtggcggcgtcgatctggagtcttttgattccggcgatggagcaggttgtcgatatgggaaagctggcgtttgtgccggcagtcgcagggttctggtgtgggatcctgtttcttcttctgctcgaccatatcatcccgcatctgcaccgtaacagccagagtgcggagggaccgaagagccagctgaagcgcacgacgatgctcgtgcttgccgtcacattacataatatcccggaaggcatggcggtcggcgttgtgtatgcggggtatctggcgggcagcacccagatttccgcggcggccgcgatggcgctgtcgcttggaatcgcgattcagaatttcccggagggggcgattatttccatgccgcttcgggcggagggaaccggaaagccgaaggcattcttaggaggcgtgctctcggggattgtggagccgatcggggcgattctcacgatcctggcggcgggactgattgtcccggcactgccgtatctgctcagttttgcggcgggggcaatgctctatgtggtcgtggaggaactgattccggagatgtcgcagggagagcactcggatgtcggcacgatattttttgcggtgggattcagcgtcatgatgatgctcgatgtggcgctgggctgacacttttattagaacgggcggatggctttgtgtctgctgggtatgaaaacgccagaaaagattccgaaaaatataccatagaaacaggagtgggaacagatgaaagtatatgaagttggagagcagggaaagccagttctcatgcttttgccgggaaccggctgttactggcgcagcaattttggaaaggtgatcgagccgctggcggagacattccgggtggcgtgcgtctcttacgacgggtttgacgagacggaacagacgcagtttcccacgatgatcgaggagacggcgaagatcgaggaatatattaaggaacactatgacgggaaaatctgtgcggcgtacggctgctcactcggcgggtcattcgttggacttatggcagcacgcggagtgattcatatggattatggcattctcggcggttcggatctggatcagtctgcaaaactgccggcgaagctgatgacagccctgatgctgccgatgatttatccgtttcttacgaccggcagatttcggcttccgtttttaaaccgtaagctggagaagtggcgcaaggcgggagacggatatgtggatgcgtttatcggcatgatgcgcggcgccggtgtggatctctcctttatcacaaaggagagcctgcgcaatcagttttattcggatctgattacgccgctgccggatgcgatcgatccggcgggcaccgagatccacattttatatgccttaaagatgggagaaaaataccgggcgcgctatcacaggcattttgcgcacccggtactgcatgaactggacatgcagcatgaggagcttcttgcagtacatccgaaggaatgggtggagctgatagaggatatatgcagacagaagtaatacggaggaagaacagcaatggaaaaaattgtggtaaaagtggatggcatgcagtgcggaatgtgcgaggcacatgtgaatgaggcagtgagggctgcgtttccggtgaagaaggtgacctcttcccatgcaaaaggggagacagtcattctgaccgaacaggacattgatgatgcaaagttaaaggaagtcatcgacaagaccggctatgagatgggaactgtgacgagggaaccttacgaaaagaagggacttttttccgcattccgtcatgaaaagtaagaaaaaggatgtctggatagagcgccctgtctggggtattccgtttagtgaataggtgcgaaggtgtgaaaccggagctttatttatgaggaatcccgggcagggcgtattttatgagttgctgtttgttatggtattcctgttctgacgcagagggcagccatgctgcacacggtaaaaaggagagagacgatggagacttaccggaatgaggagcagatgcagtgtctggcgaagagcgaaggatgcagtacgcttccggtcagcctgtatctggcggaccgcgtcagcattaccggggcgcaggcggcgcttgcggtgatgctttcgatgtcgctggtcggatcgctggcaaagcttgaagtatttttccaaaatatccgtcagatgaagatgacggcggagtagcggtgcagtaagggaaagggcgttcttatccggcggagaatccgcaatgagaaaaagtatcaacatccggggttgcaatctttttcgccaaccgttataatgacgacagttaggcgtgactaactatagtgcaaatcattttaggacttcttacaggggaggagctgctgaatccgtttcctgccggaaaacagctgcaccgggacgcgttccatcctatgtaacgaacgccttccggtgtgttttccggaagccggagtccggatggatcaaagaatcagatgattgaaaagatcagagaatcagatgatcagatggaaggagaacgaagcatgaattttttggagattgaaaaggtaatcggaagagagatactggattccagaggcaatcctaccgttgaggcggaggtcatacttgcggatggcaccgtgggaagaggcatggcaccgtcaggcgcttcgacgggagagtttgaggcactggagcttcgtgatggagataaagcgagataccttggaaagggtgtcacaaaggcagtggagaatattaacacggtcattaacgatacgatctgcggcatggacgcaagcgatatttacgcgctggatgcggcaatgattgctgcggatggaacgaaggacaagtcaaagcttggcgcaaatgccatccttgcggtatcaattgcagcggcaagagcggcggcgatcgcactggatatcccgctgtaccgtttccttggcggaatttccggcaacagacttccggttccgatgatgaatattttaaatggcggcgcgcatgcagccaatacggtggatgtgcaggagttcatgattatgccggtcggcgcggcaagctttaaggaggcgctccgctggtgtgcagaggtattccatgcactggcagccctgttaaagagcaaaggccttgcaacctccgtcggcgatgagggtggttttgcaccggatcttgccagcgatgaggaagcgatcaagtacattttacaggcagtgaaaaatgcgggctatgagccgggcaaagatttcatgattgccatggatgcggcgtcctccgagtggaaaggcacaaagaagggtgagtacatattgccgaaggcaggtacaaagtttacttccgaggagttgattgagcactggaagaagctggtggagaagtatccgattatttccatcgaggatgcgttggatgaggaggactgggaaggatggcagaagctgacgaaggagctgggcgataaggtgcagcttgtcggcgacgatctttttgtaacgaacaccgagcgtctcaagaagggaattgacagtggctgcggaaatgcaatcctgattaaattaaatcagatcggctctgtgtcagagacactggaggcaatcaagatggcacataaggcaggctatacggcaatttcctctcaccgctccggcgagacggaggacacgacgatcgcagatcttgcggtggcattaaacacctgccagatcaagactggcgcaccgagcagaaccgagcgtgtggcaaaatacaaccagcttctgcgcatcgaggaggagctgggcgatgctgcggtatatcccggcatggcggccttcaatgtgaagcgctgatcttagggagtgagcccggatcgggatagcggatcgtttcgggacttgccgtggcggcagtgcagactgcagatgagcaggaggagactgcttgagcagcttatcaggacttggcgtggcggcagtgtagacagccacagtgcagaaagaaaagaagtctgcagaaaaaataaaactttgaaaagggaaatgtacggacagccggcgcattctgcgccggctgttttttctgcctgccaggtgcaatttttttccagtttgatagatgacctgttttttgcttttttcgggtcaatggaagtatggaggagcttgtcagtctactgcgggtctacagaaggaaaaaagacttgcgggacccgaaaatgccattgcaagagggaaaaagaaacgaaaaatcagctcttgcgggtctgggaggaagaaaaagccgtgccagacccgaaaaagcagaaaaaacgggtctgggagattgattttcacgaatcagacccgaacagaaggaaaacaaatttacataacgcaaaaaaatatgctattgcgggtctgagagagaaaaaaagccgtgtcagacccgcacattgctatgcaggcagggaagaccccagaaatatttgaagaacaggtttgtgggaatagaaaaaagccgtcaaaaagtttgccggcaggataaataaattccgacggatcggacatactagcgcaataaggcaaaggcaagaacagcaggcaggaacaacaggcaggaatgaaaggttgaggcaaaaagcaggagcaaaaagctgaagccaaaagttggagtaaaagtcggagcaaaaagctgaagccagaagttggagtaaaagacaggagcaaaaagctgaagccagaagttggagcaaagagttagagcgagagatcgtgtgaaaaaatggaggattctatgaacaagtatgccagaacacagacggaaaagaatttgaaagcagcgtttgcaggggaatcacaggcgagaaacagctatactttttttgcggagatcgcaaaaaaggaaggctatgagcagattgccgcgatttttgagaagacggcggataacgagcgcgcacatgcgcagatgtggggcgaggaactgggactgatcggcgatacgggaaagaatctggatgccgcagcccacggggagaactatgagtggacagacatgtatgaggattttgcaaaaacggcggagcaggaaggctttgcggcgcttgcagcgcgatttcgcatggttggcgcgattgagaaaatgcatgaagagcggtaccgggagctcctgcgggatgtgcaggcacaggcggtgtttgagaaaagcagtgtgaaagtgtgggagtgccggaactgcgggcatattgtggtcggaaccagtgcgcctaaggtttgtcctgcctgtcattatccacaggggtattatgaggtgcgggaggatgtcaggggagcgtagaagtgtctggcgatttgtgagcgtttcgtatcagtaatatttcacaaaatttatagatcaaatacatgaaaaatatataattgacagaaactatgattacttcctattaggaacactgtaaatacaaggcttttcggagcctgcaaaccagaaaaaataatatttgatctatcacattacgcaaaaagccgtccggcatgagaaacgggcggcttttttgcgtggatagacggaaaggaggcgcaaaaataactacaaaattttagcgttcaaatttgtgcaactttaacgaaaaggaggatcgtaaatggccgatgaaaaactgaatactggccctgcggagaatatttccccggaggccgccgagcctatcgccacacccgaacaggccgtagcatctgaaccccagcaggaacagaccgggcctgccatacctgagcccggcgatgtggttgtgtcctttgacaaaatcaatgagcttatggcagaaaagagacagaacgcccgcgccgaagtcgaaaaggcggaaacccccgaagcgccggaggcggcagcccccggagaaacacagcagcccaccaatacggaggaaccgaaaaagccgcgccgtggccgtccgccgaaagcagaaaaggccgcgactgaaaatcaaaaatcggagaaatcggctggggcccgcaagggccgcccacccaaggcggataaggcggcccctgacaagcccaagccgtccaaacgagacaaagtgtcccgaagcgatggaaaggccccggatgccaaggagcccattaagcccgcacaggatacggcactgaaggaaactgctgctgtggaacagacggctcccgagccgactacaccgccccgcccggttgaggaaggcaagctggtttatctgaaactttccgaggttcatccgtttcacacattccgtccgcacccctttaaggtacgggacgatgcgaagatgcaggaaatcgttgcttctatccgcgtaaacggtgtaatggttcccggtcttgcccgcccggagaaagatggaaacggctatgaaattgtagcgggccatcgccgtacccacggcagtgagctggctggactggaggaaatgccctttatcgtccgtgaaatgaccgaccacgaagcggtacaggccatgaaggacagcaacaagcagcgtgacgggatgctccccagcgaattggccgcgctgctggaactcgaggttgaggacatcaagcatcagggcgggcggctgaaaggtgttgcggaaggcgatgtcgggaaacgctcggttgagattgtaggcgaggcgcatgaaatgaactataaaaaggtcatgcgctacttgcggctcaactcccttgtgccggagcttctggataaggtagacgataaaaagatgggcttcatgcctgccgtggagctttcctacatcaaaccgaaaaatcagaggcttattgctgtttccattgacggggagcaggcttcgccctcgctggcccaggccaaacggctccgggagctggataaggaaggcaagctcaacggcgatgtcattgacggtatcttatcagaacagaaaaaggaggatcgaggcgtgattatttctactgcggaactggaaaagtattttggcaaggaggtcactcccgccaaaatgaaagaacagattatgtccctgctggatgactggaaagaaaaacagccgccggagctggcaaaagccccgaaaaagcaggaacttgacaagtaacaacttcgagacactttgtcccgagggccccgccctcgcgcagaggctctggtggtatatatcccccgtcgccgcctgttttttagtacagccgggagtgggccgtcaagggtgcagcgcaccgccgttttcggcggctcgcccttgacggtctgccccggctgtgctatttccccggcaagcggcgggggtatatcctccagagccgccccctttcccaagactgggaaagggcgtggggtttgggttgaactttcttattaaaatatcggaggtatgaacgatgaaacgaccccttgcttatatcaccgctgcatggctcggcggcgatagcgaaaacgcagaactggcggcgcagtattgccgcaccgtgtatgaggcaggcttttctcctatttgtccgcctttgtacttgcccctgtttctcaatgatgctgttcccgaggagcataaaagcggcatcgacatgagccgtgacctgctccgccgttctcatgtgctggttgtttgcgggcacagtatgaccgaagccatgaaaaatgatattgccgtggcccagcggctgggaattacggcaacaacccttgagggcatcctgaccgtcaagggacagggccgccgctaatggcaaccctgtttgaagcctacgttaccaacgccggaaagtacagcgagggccagcttgtgggtgaaacactgaaatttcccacaaccgcccaggaggtggaggctcttttgaaacggatcggcgtggatggcgtccgctatcaggaaatttttattacctctttcgatggggatgtgctggggctctatgaccatttgagcgagtatgaaaatctggacgagcttaatcatctggcctgcctgctttccgagcttacctcatcggagctggaaacactggaggccgtcctcgacagcggcgatcactgttcttcggtgcgggacatcatcaatctgacacaaaatctggactgttacggcttttaccccggcgtatccgatgaggaaacgctggggcgcatttatgtggacgatctggaaatgttggatgtgccggatcaggtaaaaccgtatttcgattatgaggcgtatggccgggatgcctgcatccacgaaaacggccattttgccccgggcggctatgttgtcaaagaaagcgatcatttcgtggaagtgtatcacggcttgcaggatattcccaaggaacataaggtattctctttcccgaagctctctatccgggagcaaatggccgcctatcaggaaatcatagacggttcttcgctggagggctaccgtcaaatgcagaaaaaagaccgtggggatcggtgacggtacttcgagacaaattgtcccaaggaaggaggcggtgtaactgattgatgaagatatttcccggcgcacgatagccatatccgtaaaaacaaccaagctgacggcgcggggactggcgtatgtgctgggtatggtggggcggaagatccgcaaggcataccgtgggcggcaaacaccacacggcaagcaaagtgtgcgaaagctcatggcacacggtacatccacaaacagcatcgagctatccggggatgccaagtcctttgaccgtgtggcccggaaatggaatgtagactatgcgttctataaaaccgggccggacaaatacctgttgtttttcaaggctggacaggcagacgcaatgaccgcctgcttttctgagtattcccggaaggtgttaagcaaagcaaaatcgaaccgagttcccatccgagaacaactgcaacaggcggcggatcagctttccaaagaaaagccgaaacagaaagaacatgcaaaggaggtggcccatgaggacagataagattagaaaatatctcattctgaacattccctatctgttcatcctgtgggcgttcctcaagctgggaacggcctaccggctggcggcgggtaacgattttgcacataagctcatcgggctgggccagacgattggcccggcctttgctgactttgcacccggtcttgctccgctggattggcttgtcggtattgtaggcgcagttggtttccggctgctgatctatttcaaaagcaagaacgctaagaagtttcggcgggatgcagaatatggcagcgcccggtggggaacggaaaaagacatcaaaccgtttgttgatccaaggtttgaaaacaacgtgattttgaccgggacagagtttctcacgatgaacacccgcccgaaaatccccgcaaatgccagaaacttgaattgctgcattatcggctcgtccggctccggcaaaacccgcttctggctcacgccccagcttttacaggctcattcctcttatgtggtggtcgatccgaaaggcggtgtgctgggacaggtcgggggtttcctgcaaaaacgcgggtacaaaatcaaggtattcaacagcatagatttttcaaaatccatgcactataacccgctggcgtatatccgcaacgaggccgatattctgaaattcgtggatgccctgatttccaacaccaagggcgaaggcaaggaaggcgatccattctggacgaaatcggaaacgcttttgtactgtgctctgatcgcctacatcattttcgaggggcctgccgaggatcggaacatgaatacccttgtggatatgatttccggcatggaggtcaaggaggatgacgaggattttatgaacgcggtggactatatgtttgccgggctcgaaaagcgtaagccggattgcttcgcggtcaaacagtataaaaagtacaaattggccagcggtgatatatgctctaagtgacttcttaatcatgattttgtcatggttagtgaagcaatcacttagagcatttttgtttcaggaggtacagccatgagaaatgaaaaaattaccccactgtacgagcgcctgagccgggacgacgagttacagggcgagagcaattccatatccaaccaaaaacagatgttagaggattttgcccgccggaatgggctgccaaaccctacgcactttacagatgatggtatctcaggcacccgttttgaccgccccggatttttggcgatgatggaggaagtggaggcagggcgtgtagaggcaatcgtcatcaaggacatgagccggttggggcgcgactatctgaaggtcggtcaggtcatggaggttttgcggcaacgcggtgttcgtctgatcgccatcaacgacggtgtggacagtctgaaaggcgatgacgattttaccccattccgcaacatcatgaatgaattttacgcccgtgataccagcaggaaaatccgttctgtgtttaaggcaaaaggtatgagcggcaagcacctgaccggcactgtgatttacggctacttatgggacgaaaaacgggagcattggctggtagatgaggaagccgccgaagtggtacgccgtatcttctccctcacgctggagggatatgggccttatcagattgcctgcaaattatccgcagatcggattgaaattcccgtcgtacaccttgcccgcttcaacgagggtgtgaaccgttcaaagccggtcaaagacccctatggatggggatcatctaccatcgtgaacattttgaaaaaacgagagtatttggggcacaccatcaatttcaagacccgcaagcactttaaggacaagaaaagccactatgtttctgaggacgaatggacgatctttgagaatacccatgaagccattatcgaccagcagacctttgatttggcgcagaaaatccgcagcaatgtacggcgttatccaaacggctggggcgaagcggctcccctcacaggattgctctattgtgccgattgcggcggcaagatgtatgtccaccgcaccaacaatggcaagaggatttctcaatatacctgttccaattataccaaagttccgtgtgggacactatgccatacacaacaccgtatcaatgagagtgctgttctgacattggtttccgacacgctccgggctatcgctgaatattccaaaaatgaccggacggaatttattcacaccgttcaggaaacgcaggttgcccaacagagtgccgatatagcgaaaaagcgcaggcgtctggccgctgctcaaaagagagccggagaactggaaaaactgatttgcaaaatctatgaggacaatgtcctcggcaagctgccggatgcacgatatagggcgcttgatgcacagtatgccaaagagcaggacgcacttgagattgaaattgcggagctggaaaaggctgttaccggctacgagcaaagccagaaatcagcggagaaatttatagccctgattgataaatacgagaattttgacacgctgacaaacaccatgctcaatgagtttgtagagaaaatccttgtccacgaacgcgcccgaaaaggcagtcaggacaccacgcaggaaattgaaatctacttcaattttttaggacgctatatcccaccatccttacagccggttcctttaaccccggaggaacaggaagaactgcggaaaaaagaagaacgcaaggacaggcttcatcagaattatttgaagcggaaagccagcggcgcacagaaacggtatgaggacaaaatcaaggcgaagaaaaaagcggaaatggacgctaagaaagccctgatccgggctgaggatatgaaaaaaggcgttttttctactgtcggacagctgccgaaagaagaaccacgcaaaggcagcatagcagccagcgcagcagtctaatcatcacgaagcaaaggagaatgaatatgagtaagttgacttacattcgttgtggagattatgatatacccaacctaaaactttctgaacagccggaaacttctatcggcaagtacggcagaatgcgaaaatcctacctaaaggaacatcgccccattctctacaaccatctgctgatgagcgagaagctgtatccacacctgttagagattgagcggacagcacaggggcgtgtggaaaccatgttgcctcacatgatggaagttgcgggtgtcacggaagaactgaaagcctgtcaccctatgcgttgggtggggctgatgaacacattaacggcacagattgaggaaattttaatcagggaactgatttgcagctgaatgggaggtgcgggaaatgctgacctttgaaaaggttttgaaagtgtttcaggcatatctggatgatgaccctttgtatgaggtggttcagaccagccacggttatacattgatggcatgggagctccaccggaatgactggtacagcgccgagatacagaaaaccccggaggatttacggaacgctttgttgagtacatacgctaactttctggaagataagattaccggaaatgaccgcgagctgactgtgacagaaaccggagaaatccagcagaggtgtcgggaacttttggaaaagtgccgggaaccttgatatagaaatgccagaaggaggccgcgattatgcgtcctccttctgcttcgcagtctgttccattttgagcgccccgtctatggcaccttcgataatcggcaggtattgttcaggacagagcttcagcttgtggctgacccgctgccgctgtgcgctttcttcccgcatgatctccgggttaaaatatcgctctacgggaagtccgcagaccttaatcaactggatcatcacaggcaggctcggaatcgcaccttgattctcaatgttggcaagataccgccattcaatcccaaccatttctgccaatgtttttcgtgccaaacgctttgcctctcgtgcggctttgacatctgcaccgaaggtttcaaaaccgggacaatcttcaactttcgccatataacatcacccagttacattgtataattcatactttgtccgtggaatgttgctatatgcaggttggttgaagtttataattcacatttcgttccttgcattgttcgagaaagagaactataatgtactctgtggaggtgcgaaatggactatatgacattgaaagaggccgccgaaaagtggggcgtgacacctcgtagggtaaattattattgcgccggagggcgcatccccggcgctgtgaagatggctggtgtttggctgatcccaaagaacacagaaaagccgattgacggaaggacaaaacaagggaaggagttgcgccatgaataaaatcctgattatagatgatgacagagaactgtgtgctttgattaaacgcagcgtacaagcagaaaacatagaagctgatttttgtaatactggaaaagagggtttacagaaattaaaagagcaggaataccagcttgtagtgctggatgtgatgatgcccggtatggatggctttgaaacgctggaagaaatccgcaaagagaacagcctgccgattttgatgttcacatccaaaaatgacagcatttctaaagtgcggggcttacgagccggggcggacgattatctgacaaaaccgtttgatatggacgaactgattgcccgtattgcgtccctcattcgccgctacacccgttttaatcatcaagccggagctgtgcaaaaactggattttgatggattgcaaattgaccttgaaaatcgttctgttacgacggaaaatggcacttttgaacttccaccaaaggaatttgatttgctcctgtactgtgcaaagcatcaagggaaaattttgacaaaacagcagatttatgaggaagtttggggcgaagaatatttctatgatgacagtaacattatggcgattatcagccgacttcgtaaaaaattagaagtcaatccttcaagcccaaagtatatacaaacggtcaaagggattggctaccggtttaataaggaggtgtagtcagcatggaaattatcgtattcttgtccattgtgattgctgttgtggctgtattgacttccatcgttctcattcggcgcgtaaaaaagcaaatcgcagaaatgaccgatgcactggttgatgtgaaagacggaaatggcaaccggcgtattctatctgcaacaaatgaactgacagcacctcttgcctatgaaatcaacgagatcgttgtggcctatgaaagcagactttcaactgtacggcagacagaagaaaccaaccgccagcttatgacgagcctttcccacgatgtgcgaacgccccttactactctgattgggtatcttgacgctgcacacaaaggactggtcacaggaaaagaccgggatgattatattgaaaccgcccgccggaaagcccatgatctgaaagaatatattgatgtactctttgactggttcaagttaaattcaaacgagtttgctttggagatccagagcgttgaggccgcagagctgacaagaaatatcctcattgactggataccgatttttgaggataaacaggttgagtatgacatcgatattcccgaacagcctgtccgggtaagattggatatggacagctatatgaggatcgtcaacaatctcattcaaaatgtaattgctcacagccatgcagacaaaatcaaaattgccctgtcaaagaaggaaaataacatggagctgctgctggcggataatggagtgggaattgagaaggaagatttgaaacacatttttgaacggctctataagtgtgacaaaggacgctctgaaaaaggcagcggacttggtctttctattgtccatcagcttgtagaaaagatgggtgggagtataacagttgaaagtttgccgggaaaaggaactgaatttatgttgctttttcctttggagatttaagcgggttcccgtctttatggcgggaacctttgtcatttttgccggatttcaaattgcaaggttaatgcaaggttgcggcaaggttaatgcaaggttggcgtgatagaataccttacagaacaggaggttttgaatatggatacaaattacatcattgaaacaaaaaatctgacgaagcaatatggctcgcaaaagagtgtggctgacttaaatatccatgtgaagcgtgggagaatttatggtctgcttggcagaaacggagccggaaaaaccactaccatgaaaatgctgttgggcttaacgaagccgacttccggagaggtcaaaatctggggaaagtctttacaggggaatgaaaagaaattgctgccccgtatcggcagcttgattgagtcccccggtttttatcccaatctgaccggcacagaaaacctgcgtatttttgctactctgcggggtgtaccaaacaatcatgccatcaaagatgctctggatttggtaggacttccctacaaagataaaaaactcttttctcagtattctcttggtatgaagcagcggcttgccatcgcccttgccgttatgcacgatccagaacttttgattttggatgaaccgatcaacggtctcgatcctatcggtattgcagaagtacgctcttttattcgggagctttgcgacgcaagaggaaaaaccattttgatttccagtcacattctttcggagatttccctgctggctgacgatattggaattatcgatcacggcgcattgctggaagaagaaagccttgctgaactggagcaaaaaagcagtaagcatatccggtttacactctctgatactgcacaggcggcaagaattttggaacgcaatttccatgaaaaccatttttccatacaggacgaccacaatctgcgcctgcacaaccttgatctgcctgtggggaaaattgtaactgcctttgtagaaaacggattggaggtatcggaggcgcatacttgtgaagaaagtcttgaagattacttcaagcgtgtgacagggggcgaaggaattgcttaaactaatcaaatgcgaatttttgaaattaaaacggaagcccttggtatttatttctctgctgctttctgttttcatgccattggcttatgctttctttctggcagatgtaaacactgatgtggatgctgtaaatggagtgatgtccagcctgttccagctcagtgcttatttgcttttgatgccgctccttgtgatactggcttccaatctgctgtttgaggagctggacaatgacacactaaaaaaccttgttaccataccgataaacagaaccaagttggtgctgtccaagatgctggttttgctattgtttgccgttggctttatggcagttggaggattggtaaatcttgcggttttgctgtttcagggctgggagccggttgggttttggatcttgtttggcgttgggatagaagaagggctgattatgtgggtaggcgcacttccatgtatcctgctcgttgttcttcttaataaaaactatatcgtgtcggtcgtgattacctttttctatacgactgcaaattatatcctttcgatgagcgatgcgttcctcacacagccttttggtttgaatatcggaaccctgtttccgggaccgctggctttccgctggaccttccaattttatgaccaaagccagaccagtgcggaattggcagacttgttggaacggatcagtccgtattttctgaatggtgttcaggtgttcggtgtgattgttgtggaagccgttgtatttcttgcgctgattgcgttggtttaccggcgccaggaaatctaagggggtgtaattatgtgggatttattaaaagcagaattgctcaagctacgccggtgccaaatactttgggtggggctggtggcgcttgcactctgtccgttggtgcaatatgggagccagctgattgtggaggcggagtaccgaaatccaaactatgatttttccactctgtttgagaatgttgtctggggcaatacgcagatgttttttccgatttcactggtgatgattggcagctggctgattgacagagaatccacccatgatacgctgaaaaacatcatgacaattcctgtttccatgccgaaaatgctgggagctaagctcttttgggtcgggatttttgcagtcctgctgggaatatacagcgttggcgttaccttgattactggattgacggttggattatcgggactgacagtggaagtgttttttcatggaggtacacagatcgtgttggcagctctgacgacctatttggtctgtatgccgctgatcttgatttttgggcagatccgaggggcatatctgggaggttccattctggcgtttttccttggatatagcatgctgttcttcaaaggcggtatccttgccagcatctatccgttttctgctgcgctgattttagtgggctttgacatgagtggatatgccggaacaaccacagccccgaatcctttgctggcagtcattggggttggcatcatggttctctgggcggtgctgttgttactgatgtccagtaacaaaaaagaaataaaatcccgtaaacaggcaaattccaagggaaaaggaaagcgtgctgtacgcaggaaaggaaggtgatacctgtgaagaaaatagttctatcattatgcttgatactgttgggcgcttctgtgctttccggttgtacaaaagatgaagttctcgatcagtataacaatattgttcagtctgctggttccatagcacttaccggaaattcatccttacaaggtacgaaagaaaaaggaattgatgattatacaggaagctatacagccaactatgaggatttttcagatacagagtatttgttcggcggaacttccataaagcgtgaagcgggtaaggatctgtctattgactgcgcgctggaggttacggatggaactgcaaaagtattttggatttctgaagctgatgaagaagtcactttgcttgaaacaaccggaacatatagtgatacaattacactccctgaaggtggaaactatatcggcattgaatgtgaaaatttcactggaagcattgaattgaatatggagtaacattctgccggacgacggcaaaagaaaaaaagccgtcgtaaagcagacacatttccacgcgcctatgaagcggcggctttgatttgcagagccgccgtttcttttcgtttatcctaaaccaacgacgacctaacaccgtgtaaatccacggcggcacataggaggattgccgccgtgtctatttttgccttttttcacagtgcccgtgatctgcaccagctaaaaaaagcctgttcccagcagcggagcaatgcggtcagcagtatgcactataccatgtaactgaacaacaaaatatactctattacgctcgtatggctttatgccgtccgggcgcttttttgtccttatggagccggaacatcgggtcagcatggcccgaactttatccccggtgccgctccccgccgcctcattcagatttacccaaaaaatctgaatggaggaaaggcagatggaagttaccatcaattataacggacaagttgtggccgtggaggtcacgctggaagtctatgaatttcttgaccgggccgatcacaaaacggagaacctgtttcatgaacagcggcggcattgggatggccgggagtttgacgagtacatcattaccaccgagggtgtaggagcctacggtgaaacgccggaagaatacctttgccgcatggaaacgctgcatgagctgatggcggttctggacacctgtaccgaggctcagcgccgccggttcctgctctatgcgcttgacgggctgagccttgcagagatcggtgtgctgtgcggctgctccaaagtggctgtgtatcaaagtgtggaggcggtcagaaaaaaatttataaatttctttgagaacaggcttaacgaatgacctgttttctggctaccaagtgaaagggatcatttcccttatctcagcgaggggcggacagcggacgagctgcccgcctctccgattttcaggaggtaagcctatgaaaacaatcaatctgcggtggatgtatccccactaccggcatgacgagtttgtggatgttacggacgaggtatgggcagcgatgtatcaggcccagcgggagatggagaactatgagcgtcggaaagtctaccaccgcgcctactactctctggacgcatacagctggctggaaaattacgcactggaacacagcagatcgccggaagatattttgctggaacgagaagaaatgaccacccgcctgcacctgatagcagctctgctggtggctctgactcatgccactccgacacaggcccgccgtgttcacgcctactacattgccggtatcaagcagccggaaatctcccggagagagggcgtccacagcagcaaggtcagcgtttccatccgtcggggtctgcggaatatgcgccgctgctatgatgacctttttcaaacagagtgagggcgtgcctatgcagaccatcaatctcaaacaatattatccattttgcaaagaggacatttttgtggaggtgtccgatgagatcgtcgaagcgtttcttctggataagagagccgaggccgccagagagcgcaagatgttccggtataaggcgttttattccctcgattgtaacgacggaatcgaaaatgccgcaatcggctgggcacagccatcgccggaggatcatctgatagaaaaagaagaattagccgaatacgaagaactgatacggcgattgtatgaagccatttcttccctgccgcctatgcaggcccgccgtgtccacgcccgctatatgctgggtatgaaagtgaaagatattgccgcaatggagggtatcacgccatcacaggcgggaaaatccatccatgccgcactgcggaggctgcgccggtactttgtgcgtcagaaatggacggtcaatctatgagtatttccaaagaaaagaggtgcatgacatgaacgaacagaatacagcccaaacaaaaagtgaggaacaagaggaagttctgaaggagattcggcagcttgaaaaccgaaagaagattttggagaacaagcagcgaaacgaagaacgcagggttcgcacccgccgcctgattgagcgcggagccattttggaggggatttttccgctggctcccaacctttccggcgcagaggtcaaagcatttttgattgccctgtcccatcttccgggggctgcggaattgactgcaaacctgtcaaaatccggggatacgccataagtcccttgtttacaagggcgcacttatacaccgttgccggtgctgtgcgccctgccgggggcgttgcgtacttcgtccgcgatgggaagctacgctccccaaaccccttgtgcgctctgcgcagccaaacacccactttgcgtttgtccggctccacagagcctgttatccctcactgaaaggaggtgttccccatagatttctgtcatatccccgtcagtatcatcaagcgcagcgcaggccgttctgccgttgccgcagctgcttaccgcagcggaaccaagttgacaaatgaatgggacggaatgacccacgactacacccggaaaggcggcattgtccatgcggagatcatgcttcctgcccacgccccgccggaatttgcagaccgttctatcctctggaacagcgtggagcaaatcgagaaagcaagggacagccagcttgcccgtgagatcgaggcagctctgccccgtgaactgtccggtgaacagcagcttgcccttgtgcgcacctatgtgaaggacaactttgtagacaaaggaatgtgtgctgactttgctatccatgacaagggaaccggtaaccctcatgtccatatcatgctgacgctccggcctctgaaagaaaatggacagtggggcgcaaagtgccgcaaggcatacgatctggacgagaatggacagcgtatcccggatgggaaaggcggctggaaaaatcacagagaggatacgaccaactggaacgataaaggaaatgtggagatttggcgggcagcgtgggcggcctacaccaatcgggcgctggaatctgccggcagaccggagcgcattgaccaccgcagctacaagcggcagggcattgataagattccctctgtccatctggggccagccgccagccaaatggaaaagcgcggcatccgcaccgacaagggagaagtaaaccggcagattgccgctgacaacaagctgctgaaagaaatcaaagcccgcattacccgtctttatcgctggtcgaaagatgaagcggaaaaaccacaaacacagcaaagcagcttgaccgccttgtgggaggcccagcagcagctgaacacttcccgcacccgcaccggcaaaatccgggccttgcaggaaagcgctgcactattcagctttttgcaggcaaacggcatccaatctatgcagcagctccatgaaaaaatcgctgatatgaacatccgttactatgacctgcggggaaagatcgtcaaggcagaacgccggatcgccgctcttaccgagcgcggggagatgtgggaacagtacaatcagtacaagtccatccacaaacagcttgccaaagtaaagccggaaaagcgggaacagtttgagcagcgccacagcagggaactgatcctgtatgacgcagcagcccggtatctgaaagaattgaaagacagcggtgaggcaattaccccgaaggcatggcagcgggaaatcgaccagctgaccgccggaaagcagacggacacgctttccatgaaatccatgcgggaggatttgaaagcagtggaacggctccgcaaaaccgccgatcagctgtcccgacaggaaagggataagtctcacgaccgtgggccggagcggtaaaggctaccgcgttttggcgtacccctgtcaagtgcgtcgcgtttcacgacatacttttgcatacagaaaaaccgtcgtacaggtttccccatacggcggcagactgtttatttgccgaacaagtcgctgtgtgtgccggtgcgggccagcgtcagcaccagaacatcatcctctatgcgatagacaagcagccagtccgggagaatatgacattcccgatgacctgcccaatcgccggacaggtcatggtcacggttcttatccggcagcggttcgcccattgccagcaatgctacgacctgctccagcagctcaatcttcaagccacgcttgatggctcgtttgtagtcctttttgaaactggtcgtgtacttgacggtatatttggtttctttcatcttttcaggtcagcaaataactcgtcaaggtcattgtagccctttacagacgggtcttttgcaatcctttccgcttccagcatggcagcaaccgtttctttgttcggctgttccagccttacttcaaagggaatgccgccttcacgaagcgactggcgcacaaagatgttaaacgccgtagtcaggttcatgccaagttccgtaaacagtgcgtccgcctgcgctttcaaatctgcgtccatgcggatactgatgtttgtggtatttccagccatacgatcaacccctttctgctggcaattatagtatatgccatttgcacgaagaaaacaatactttgcacgaatatttaacaataaattcattcaaggaggttacctgctttatgaaagaaatcatttatgaagaacaacaagactgaacctatccctgtcatggattaccgccagtaccgcagagcgcggaaactggtgcatgagtgctgcaactacattgccggaaactgtatcgccctggacgatggggaggaatgtatctgtgtccagtccatttcctactccctgttgtgcaggtggtttcgggcggcggtattgccgcaggataaggaactggaaacggcgctgttccaccggctgaatgctaagaaatgcgccgtatgcggggcgctgtttacccccggttctaaccgggctaaatactgcccggaatgtgccgcacgcatgaagcggattaacgccgcaaagcgcaagcggaaacaacgggagaaatgtcacgctttaggggctgaaaaacccttgtaaatcaaggctttttttgagggtgtcaaaggcagtctgatagatttatcctctgacccctaaaatagccttaaaatgcgtacagaatcccaaaagaacccctaaggaggaaccctatgtcagacaatcgaaaatattattacctgaaactcaaagaaaactattttgatgatgattccatcgtgctgctggaaagtatgcaggacggtgtgctgtattccaacattctgctcaagctgtacctgaaatcgctgaaacatggcgggcggctccagcttgacgaggacatcccttacacagcgcagatgatcgctaccattacccgccagcagatcggcactgtggagagagccttgcagatctttttgaagctgggtcttgtggaagtgctggacagcggcacattctacatgagcaacatcgaacttttaataggccagtcctctaccgaggccgagcgaaagcgggctgcaaggcttcaaaataaggctctttctgcgctccggacaagtggcggacatttgtccgacattcgtccaccagagatagagatagagttagagaaagagatagagataaagagagagatagagaaggtacgccctgaaacggggcacccttcccacacctatggccgttaccagaatgttttcctgacggatgaagaactggcagacttgcaggtcagctttcctgctgtatgggaacagtacatcgaaaagctgtccgagtacatggcttctactggcaagcgttatcagagccatgcagcgaccatccggcgttgggccggtgaggacgctaaaaaaacggtcacaccctcacgcaaccgggattacagcgtaaaggaggatgaaactgtatgattgagattaccgcagaaatccgggcattcatcgacaaggcagctgccggtgtggaattggctgaggacgagtatatagacccgtcagacgggctcattcactgtaagaaatgcggcggccagaggcagaccgttgtgccatgcttcgggaaatccggctactttatgccgcactgcatctgccagtgccagcgggaggctgaggagcagcgcaaggctgctgaagaacggcagcgccgcatggagcgtatcaaacgccgaaaggcacagggcctgcaagaccgttatctgtacgactacacattttccaatgataacaggcaaaacccattgatggacaaggctcatgcctatgtggagaactggaaagaggcatataagagcaatatcgggcttttactgtttggagatgtgggaaccggcaagtcttttttcgccggatgtattgccaacgctctacttgaccaggatgtgccggtgctgatgacgaacttccccaccattctgaaccgcctgacagggatgttctctgaggacaggtcagagtttattgccagctttgacgaatatgacctgcttatcattgacgatctgggtgtagagcgcagtaccgaatatgctatggagcagatgtttttcgtcatcgacagccgctatcgcagccgaagacccatgattatcacaacaaacttgaaactgtccgagctgaaaaatccgcctgatctggcccacgcccgtatctatgaccgtattttggaacggtgtgcgccgatcctctttgacgggaagaatttccgggaagaaaatgccggtgtcacccgacaggcagcaaaagacattgtaaacagtaagcacgattgattttttaccgggcggcacagacccgttcggagaaaggagcgctatgaacaaagaaccccgtactatgcagatggcagacgccgctgctgcggccagagcgccggaaaacacgccagcgatggtaaagaaaatcggcaagacgacctacaaggttcatgtccatttcagcaataccagcacagaaaccatgagcgataaaatcaagcgtatgctcaaaaatgaaattcagcagatgtgacagactgataaactaagccgccttgtgctaaactgatgatggtacgcaccaaaatttttgtcaaggaggacatgaaaatgctttacacagaaaaagagaaacatgaaattgagcgagtaaaggaagtctttgcggaacatctgcggcaaagccctgattttgaattgctctggtcggacaaggtgggctatgtctggctgacgattggcgtaaatccagtctatgtggataccggtatcaggatagaatctgccgccgatctctgcggcaagtgtttggatgatgttgctacggatgttttatatatgactggcaacgatcatgcactggaagcagccgacccgctggagttagccgaaatcaagcggctctgggagccatatatcaaccagctgccagactatgcgtatctctgcaaagacctgctgaacggaaaaatgtaatctgttaaatgaggtgtcaggagccatacagtgcttctggcaccttttgtgagttttctgtgaatttgattaaaaagtccttgacaatttgtctctggcaagacggcaaaaagcattttgatttcctgcggtgcgcgactggctccctttgacatcccgcagcttcgtgaggtcatggcctatgacgaattggagcttgaccgcatcggagatcggaaaacggcggtattcttcattatttccgataccacgcagacctacaactttttagtggcacttgcattttcgcagatgttcaacctcctgtgtgaacgggcggacaatgttcacggtggccgcctgccgcaccatgtacgggtgctgtgggacgaggcagccaacacgggacaggtgccccagctcgaaaagctggtcgcggttatccgctcccgcgaggtgagtctttgcctgctgtatcaacagttggcacagtgcaaggccatttacgataagcacgccgagacaatcctcggcaacatggacagcgtggtgttcctcggtggccgcgaagccagcactatcaaggaaatctccgagaactggctgggaaaagccacaatcagtatgcagaccgacagccgctcccgtggccagtcggaaagctacagccaaaacacccagcggctgggccgggaactgatgaccccagccgagcttgcaaccatgccgggagacaaatgtattttgcagcttcggggcctgcccccgttcttctctcccaagtatgatctgaaacggcatccgaactaccgttatacggcggaggccgataaacagaaaaacgcttttgacctcgacaggctcattaaccgccgcaggcggcccgggctgaacgaggcgtgtacgatgtatgaggtggctgtgccggacgatgcactcacggaagaggacgaggacatcctcaactatgatgacatcgacgatccagacgcctttgcataaacgcttcgagacaaagtgtcccgaagtttgtaacctgccgcctgcatgggcggcttttttgttaccggaaaaatcccggagaaatggaggcttatatggcatttttctcatctgcaatcgacactttacagaccctcgttatcgctctcggcgctggccttggcgtatggggtgtggtcaatctgctggagggctacggctcggataacccgggctccaatgctcatgtgcggtaaagtaataaaaagatttaggtagccgccttaactattcctaaataagataatatgcacagtattttctcgtaaatagaaaataaattattgcattttaccaattattatgttaaaatgacaatgtaacaaagagctatgtatttttatagaaagcattgagaatatttcaaaatttcttgaaagtactctcagtgctttctttgataatatgaaaggagaaataaatgcaaaaaaaacaactttctgtattagtactaattattttatgctttttattaggatgtaacagagaaacaccaaaagatgaatctcaacaaaattatgaagatgaatctaatatttctaaaacaaatggagaagaacttgtaaatataaacagtgaattgttaggttcgactccttttgatatccaaatcgataaaacagcattgcagactagaaaagaaacagaaacagaagttacaataaagacaaatttaacagactggggttatactgtttcttctgaaaaagggaaaatatctgatataaataaaaattcattcatatatatagcacctaaagatgagagggatgatactataaaaatacaattatcggactatgaaaatggcatatcatatgaatatacaattccacttatttttgcgggaaacaatgaacattctttagataaattcaaggaaaatctttcaagattacctaatagttagtaaagagtcgatagactaaagtaccaccatcctcttttatttcaactgaatatccatcccgccgcaccgcagcggcacatgaagcagtaaatccgaaaaagatttgctgctttttttgcgtccatttttggcaaatttccaaaagttccgtattagacagtgaaaccaaaaaaggctgccatttttttcagacagcgggcaaaacgcagcttccgaaacgccttattgtcgggaaagaccgagccgccggaaaagttcttgccggaaagtccgtccattctgctcttttgtggtttgtagggagtaagggaaaaacgccagcccgcagccttttataaaaaaagctggttatagattttctgaaaaagtggcagtagcaagtgaacggcaggccggcagtttcttagagcaagattctaccgaggtgccaaaattcgcttatcgctcattttgcccctgcgggaatcttgttggggagtgccttccccaaaccctgcttatgcggcttgcgccgctgaaaaacccctcaaaatatttttcggatttttcaaaaacagttccgcttcacaccctgtttttctcctattagtgagaggacaccacgcacagaaaggaggtcaaccacctatgaaacgatacaacacgccgcaccgcagccgggtagtcaaaacacgcatgaccgaggaagaatacgccgagtttgcccagcggctttctgcttaccacatgagccaagccgagtttatccggcaagccataaccggggcagccatacgccccatcataaccgtttcccccatcaatgacgagctgcttgccgctgtcgggaagctgaccgccgaatacgggaggatcggcggcaacttaaaccagatagcccggacgctgaacgagtggcacagtccctatccgcagcttgccggggaaatacgggcggcggtttccgaccttgccgccctaaagtttgaagtcttgcagaaagtgggtgacgctgttggcaacattcaaacatatcagctctaaaaatgcggactatggcgcagcggaagcctacctcacatttgagcatgacgagtttaccatgaagcccacccttgatgaaaacgggcggctgataccgagggaggattaccgcatttcttccctcaactgcgggggcgaggatttcgctgttgcctgtatgcgagccaatctccgctatgagaaaaaccaaaaacgggaagatgtgaaaagccaccactatatcatcagctttgacccacgggacgggacagacaacggcttgaccgtagaccgggcgcaggagctgggcgagcagttctgcaaggagcatttccccggacaccaagccctaatctgcacccacccggacgggcataaccacagcgggaatatccatgtgcatatcgtcatcaactccctgcggatttacgaagtcccgcttctgccctacatggacagaccagccgacacgctggagggctgcaagcaccgctgcaccaacgccgctatggaatatttcaagagcgaagtcatggaaatgtgccaccgggaggggctttaccaaatcgacctcttgaacggcagcaaggaacggataaccgaacgggaatactgggcggcaaagaaagggcagcttgcccttgacaaagagaacgccgccagagaagccgccggacagccgaccaagcccaccaagtttgaaacggacaaggcgaagctgcgccggacgatacggcaggcactttcccaagctggcagctttgacgagttttcttcccttttgctgcgggagggtgtgaccgtcaaggagagccgggggcggctttcctacctcacgccggacaggacaaagcctatcacagcccgaaagctgggggacgattttgacaaggctgctgtccttgccctgctcacgcagaacgcccacagagctgccgaacagaccaaagccatacccgaataccctgccgcagttaaaaagccgttacaaggggaaaaagctgcaaaaaccaccccggcagacaacaccttgcagcgcatggttgaccgggaagccaagcgagccgagggcaagggcgtgggctatgaccgctgggcggcaaagcacaacctaaagcaaatggcagctaccgttaccgcctatcagcagtacggcttttcctccccggaggaactggacgaagcctgttctgccgcctatgccgccatgcaggaaagccttgcgtggttgaagcaggtggaaaagacgctgaacgggaaaaaggagctgcaacggcaggtgcttgcctattccaagacccgccctgtccgggacgggctgaaacagcagaaaaacgccaaagcaaaagcagcctaccgtcagaagcatgaaagtgactttatcatagcagacgcagccgcccgctatttcagggagaacggcatttccaagctgccgagctataaatccctgcaagcagagattgaaagccttatcaaagagaaaaacagcggctacaacgattaccgggcaaaacgggaggagtaccgccgcttgcagactgtcaagggcaatatcgaccagattttacgccggagcgagccgcagcgcagaaaggagcagagccatgaacggtaatatcccccgcatggactaccgccagtaccgggcagcccgccgccttgtgcatgagtgctgcaactatgacagcgggaactgcctgctgttggaggacggcgagccttgcgtgtgtgtacagagtatcagctattcgctgctctgccgctggtttaccgccgctgtcctgccccttgatgaagcactggaagccgccctcttgcgccggggaagccggaaacgctgcgctgtctgcggggcgttcttcttcccaaaatccaaccgggggaaatactgcccggactgcgccggacgcatgaagcggataaacgccgccaaacggaagcggaaacaaagggagaaatgtcacgctttagggcatttcaaacccgcataaatcaaggcttttttggagggtgtcaaagggtgcgtgatacatttatccttttcccttaaaaacgccccctaaaagcgtaacagaacccacagacagacaccacaaggaggtgaaccctatcgctgattatatgaccgcaggaacggagctgcccgcttacctgccttacccccgtttcctgctggaaacagacctatcccacaccgcaagagagttatatgcgctgctgttagaccgttccaccctttcgcagaagaacggctggcaggacagcgagggacggacatacattgtctaccccatagcagagatagcggaaatgctggataaaggctgcaccaccataaagggcgcactgaacgaactggacgctgccgggctgctggaacgcagacggacgggcttttctgccgccaaccgtctgtatgtgaaagtgccgcctatcccagtggtacagttttccgaccaactgacggacggaaaaccgcccctcataagggcgggaaaccgaccaactgacagccggaaaactgaccttatgacggtcggaaaaccgtcccctaaccaaactaatataaacaacctaatagagagccaaacaaaaggagcgagtgaggggcagccccccgccgcttatggcagatataaaaatgtatttctttctgacacagaacttttggagctggaacaggacttccccggcaagtgggagtattaccttgaccgcctttcctgccacatcgcttccaccgggaagcagtaccagagccatgcagccaccatttacaagtgggcgcaggaggacgctgccaaagagaagccaaagaaaggcataccggactattcattcaaggagggagaaagcctatgaccgatacaatccacaacaccatactgcctatgaccgacaccacagccgagccggaggattacaccggggaggacgggcttttatactgcggcaaatgccggaaacccaaagaagcctatttcccagagggcaagacctttttcgggcgtgaccgccacccgtcagagtgcgactgccagcgggcagcccgtaaggaacgggaagccgccgagaagcggcgcagccaccttgaaacggtggaacggctgaaacggcagggctttacagacaagaccatgcaggactggacatttgccaacgataacggcagctgcccgcagatgaagaacgccgccggatatgtggcacgctgggaacagataaaggacgggaactacgggctgctcttgtggggcagggtaggcactgggaaaagctattttgccgggtgtattgcaaacgccctcatggagcaggaagtcccggtgtgcatgacaaactttgcagcaatattaaacgaccttgccgccagctttgcgggcaggaacgaatatatttcccgcctttgcagcttccccctgctcatcattgacgattttggaatggagcgtggcacagaatacggtctggaacaggtctacaatgtgattgacagccgctaccggagcaggaagccgctgattgtgacgaccaacctcacgctggaggaattgcagcacccggaggacaccgcccacgcccggatttatgaccgcctgcttgaaatgtgttcccctctctgctttaccggggagaatttgaggaaagccgccgcacagggaaaaatggaacagctgaaacggctgcttgccggaaaggagatttgcctatgaccgacacccagagaaacaaacgccctgcccgccgcccggactgcgtgaccgaaacgaggataggcaacacaatccttgtggtgtctggctttttcaaggagggggcgaccgacaccgccgctgacaagatgatgaaagtgctggaagcagaagccgccgccggatatttgacctgtgataagcctgattgaaaaaccgtcatttttaccgaccgtaaagaagcagatttgacgcttttgccgctatacagacagccgccccatgtggtacaatcaaggtacggaatagtggggctggctgtcggaaacggaggaatttatgttaagacagaccacccagcaactcattaccgccctttacccaagactgtcccatgaggacgagctgcaaggcgagagcaattccatttccaaccaaaagaggattttggaaacctatgccaaacagaatggattttctaatctgcgctggtacaccgacgacggttattccggtgcgaactttcaaagacccggatttcaagccatgcttgcagacattgaagcagggaaagtcgggacagttatcgtcaaggatatgtcgaggttagggcgaaactacttacaggtgggaatgtacacagaaatgattttcccacagaaaggtgtccgcttcatcgctatcaatgacggagtggacagcgcacagggggaaaatgattttgccccgctgcggaacatttttaacgaatggctggtgagagatacgagcaagaaaatcaaggcagtaaaacgctctaagggcatgagcggaaagcccatcacaagcaagcccgtctatggctacctcatggacgaggacgaaaactttatcattgacgaggaagccgccccggtggtacggcagatttacagcctttgccttgccgggaacggtccgaccaagatagcccgtatgctgaccgagcagcaaatccccacgccggggacgctggaataccgcaggacgggcagcacccgccgctaccaccccggctatgagtgcaagtgggcgaccaataccgtggttcatctgctggaaaaccgggaatatacgggctgtctggtaaactttaagaccgagaagccgtcctacaagctgaaacacagcatagaaaatcccccggaaaagcaggcggtttttgagaaccaccatgagcctatcattgaccgggaaacgtgggaacgggtgcaggagttacgcaagcagcgcaaacgccccaaccgttatgacgaagtgggcttgttctccggcatactcttttgtgccgactgcggcagcgtcatgtaccagcagcgataccagacggacaagcgcaagcaggactgttatatctgcggaagctacaagaaacgcaccgccgactgcacagcgcactttatccgcactgacctcttgaccgctggcgtactctccaatctgcggaaagttaccagctatgcggcaaagcatgaagcccggtttatgaagcttttaatcgagcagaatgaggacggggacagacgcaggaacgccgccaagaaaaaggagctggaagccgccgagaaacgcatagccgagttatctgctatcttcaagcggctgtatgaggacagcgtaaccgggcgcatatcggacgagcgtttcacagagctgtcggcagactatgaagccgagcagaaagaactgaaagaacgtgccgccagactgcgggaagaactttccaaagcgcaggaagccaccgcaaacgctgaaaagtttatgaatgtggtacgcaggcacactaccattgaagaacttacccctactctgctgcgggagtttgtggagaaaatcgttgtccatgaaagcgttgcccttgacgggaaacgccggggcaagttacgcagacaggaaatcgaaatctattattcttttgtcggcaaggtagaactgcccgacacctaaccgcccgacctatccgacatacctcatgtgccggataggaacggcaaaattttttacacttctattacttctttatcacacataagcaaagtcccagggcatgaagcagctcatggcgggtggcggcatcatcgtcattggcaccacactgatccctctgctgtctggcctgttttaaggtaggcgcttatggattttctcaccgactggctcacaaactggctcaaagagcttctgattggcggcatcatggggaacctcgaaggtctttttgatactgtcaatacccaagtcggagagattgcggcacaggtagggactaccccggcggcgtggcacgccggggttttctccctgatccgacagctttccgaaacggtgatcctgccgattgccggaatggtgctgacctttgttgccacttatgagctcatacagatgcttttggaaaagaacaatatgcacgaggttgacgttgcgaacctctataaatggatgttcaaaacggcctgtgcaatcttaatcctgtcaaacacattcaatatcgtcatggctgtgttcgatgtgtcgcagagcgttatcgcgcaggcaggcgggctgattcaaggctctaccgatgtttcggcggatatgcttgccgaactggaaacctcgctggaggcgatggacttagggccgcttttggggctttggctgcagtctgcgctcattggatttacgatgaaggcgatggggattatcattttcgttttggtgtatggcaggatgctggaaatctatctgctgaccagtctggcccccatccccgttgctacgctttccaaccgggagcttggcagcaccgggcaaaactacatcaagtccctgtttgccgtgggctttcaagggctgctgattcttgtatgtgttgcaatttacgcggtgctcattcaaggcatcgcaacaagcggcgatcccatcggggcgatttggggaactgtgggctacacggttttgctttgcttcatgctctttaagaccgggagcattgcccagcgtatctttggcgctcattaacaggaggaggtgcttatgccgagaagatacggggcggatggaacgcgcttatggaatggaaaaacgccggaggagtttactgaggcggatgcttaccgctttatggtggaaacagaggccgtcctgcaaaggaaagagctgatggacgatcccgcccagcctgctccggcaagcggaaaggaggaattttatctgagtaagaaagacgatgtattgctgaccccggagcagattgctgcggaggagcggcgctggctgtttgatgctcccatcgcggagcttgcggaagtcaagggcgttagtattgacgaggcggtaaaaatgcggacggatgccgtcttgcaagaggcggttgttccgatcacagtatctgtccgcccgattgagccgcagggtaaactgatcggcttcgccagcgtcaactttggcggtgtggtcatcgacgattttaaggttgtggatgggaaaaacgggattttcctcggtgctccctctaagcccgatcctgccagccggacgggataccgggctacggttcggattcctgaccgtgccatacaggaacggatcaatgcggctggtgtggaggcgtatcatgcggcggtggaacagcttgttgcacgggcccaggcggtacggcctgccccgatcaaggagcagatggccgaggccgcgaaacaagctggaaaagaaaatgccgcccggcctgcacctgccaaagcaaaggaggcccgcaatgaccgatagccgcactttgggacaaagtgtcccgaaggagggcttgtttctcatggacggcatcgagggcctgcgttctttgccaaaacatagcgtggatatgctgctgactgatccgccctacggcacaacccggaattattgggatgtgcccctgccgctcccggagctgtgggaggcggtgaaatgggcggtcaagccgaatggcgcagtgctgtttttcgcacagtgcccctttgacaaggtgctgggcgcatccaacctcgccatgctccgctatgagtggatttggtacaaggagcgcggaacgggctttctcaatgcaaaccgggctccactgaaaaagtccgagaatatcttggtgttttaccagaagtccccggtctacaatccgcagtttacttatggcaagccttatacccgtgttcattcccgaagcggtacaagctccaactatgggaaatttgaacggcagggctccgagtccaacgatggccgccgctatcccggaaatgtactatttgtgcctacggtgtccggcggcatccatcctacacagaagcctgtggagctctgcgagtatctgatccgcacctacacccgtcccggagaactggtcgcggacatttgcgttggctccggcacaaccgcgattgcagccatcaacacagaacgccgctttgtatgctttgaaacggccccgtccttttatgccgccgccagtgagcgcatccgtgcggcgcaggcagtaaaaagctccggcgagaaaggagtgtaattatccagcagtattctatcatttacgccgatcccccttggcgctactcggctaagaaagtacagggcgcggcggaaaatcattatcccactatgagcattgaagagttatgtgcgttgcctgtggctgatcttgcggccccggacagcgcactctttttatgggctactttcccgcagctcccggaggcgctccggctgattgaggcttggggcttcacctacaaaagcgttgctttcgtctggctgaaaaagaacaagaaagcagatagctggttttatggccttggcttctggacaaggggcaacgcggaaatttgtctgctggctaccaagggacatccgaagcggcaggctaccaatattcatcaatttatcatttccccgattgaggcccacagcaaaaagccggacgaggcccgcgacaaaatcatttccctgatgggcgatctgccccgcgtggagctctttgccagacagaccccgcgcggctgggctgtatggggaaatgaagtaacaccaaccatcccggactttgggacacattgtcccgaagtgcagaaaggagtgtgatccatgccctatgtaaacgtaccaaacgatttatccaaaatcaaaacaaagatggctttcaacctcaccaaacgccagcttgtctgcttcggcagcgcgggcgcggtggggattccggcctatctgctgacccgtgccaccctcggcaataccggggcgatgtttctcatgcttggaattatgctcccggcgttcttgctggcgatgtatgaaaaggacggcttaccctttgaaaaggttgtgcggaatatcatccgggtcaagtttctaaggccggggatcagggcctaccgaaccgaaaacatttatgcgccctttaccgggccgggcgctggaaaggaggatgtgattgaaaaacacaaagaagaaaaacggagccgccgccaagggtaaaggccgggcggccctgtctgcccagcagacaatcccgtatctgtccatgcacccggacggtgtgtgcaagctcccgggtgggctctatacaaaaactgtggaatatgaggacatcaattactccgtggcatccaccgaggatcagactgccatattcagcggatggagttcatttctcaactactttgacagttcgctgccgttccagctttcctttatcaatcgccgttcccattcccgcagccgctatcaagtcaatatcccgaaagcggatgacaactataacagcgtccgggacgagtttaccgggatgctgaaaaatcagattgccaaaagcaataacggcattgaacgctcaaaatacatcacctttggcatacccgccgaggggattgcggaggctcggccccgtctggagcgtgtggaggctgatgtcatgggaaactttaagcggctgggcgttccctcggagcctatggacgggcgggcccgccttgcgctgcttcatagccagatgcatccggggagccgcgaggcgttccgcttttcgtggaaagacatcccacagaccgggcttggcacaaaagactttattgccccggacagtctcgacttccgccagtcccgcacattccgtatcggccagtattggggcgcggtgtcctacttacagattatggcatcggagctttcggataagttgttggcagaaatcttggagctggatgcggaaatgaccgtgaccatgcacattcagaccgtggatcagctcaaggcaattaagaccatcaaggggaaaatctcggacatcggaaaaatgaaagtggaggaacagagaaaggctgtgcgctccggctatgacccggatattcttccccctgacctgattacattcagcaaggacgcagcggagcttctggctgatttgcaatcccgcaatgagcgaatgtttctgctgacctttacggtggtaaaccttgctcctaaccgccagcggctggaaaacgatgtgtttaccgtgggcggtatcgcgcagaaatacaactgcgctctgcgccgtctggactggcaacaggaacagggctttgtttcctcgttggcccttggttacaacgaggtagaaatccagcgcggtatgaccaccagctccacagccatctttattccttttatgacaagggagctccgcatggctgggcaggccctctactatggcatgaacgcactttctcacaatgtcatcatggctgaccgcaaaaagctgaaatcggcaaacgggatgtatttgggctctacgggctccggcaagagctttgccgcaaagcgcgagctcttgaatgtgtttctcaccatcccgcaggatcggatcatcgtggttgacccgatgggcgaatacgctccgctggtgcgaaggctgggcggccaggtgatcgagattgccccggacagcccgcaccacctcaatccgatggatgtggagctcaatatggccgccggagaaagcccgctttccatgaaggcggattttcttttgtccctatgcgagctggtggtcggcggcaaggaaggcttgcagcccattgaaaagacggtcattgaccgctgtgtgcgtttggtgtaccgggaacaggcgctcggactggaaactgcaaaaacaccgctgttgcaggatttgtacgaagagctcttacgccagccggagcccgaagcccggcgcgtggcaactgccttagagctttattgcacaggctccctcaatctctttaaccatcctaccaacgtcaagacggacagccgtgtggtgtgcatcgttctgaaaaacatgggcgaaaaccttagaaagattgcaatgcacatcacaaatgagtttgtttcgcaggcggtggatcagaacttccacgagggtgcggcgacttggtgctactttgacgagtttcatatcctgctccgcgatccgctgacagccagctactttgtggcagtctggaaaatgctacgtaaaaaaggatgtgtgccgtctgctttgacgcagaacgtcaaagaccttttggccagccgggaaatcgagaacattttggacaacacggattttatgattctgctttcgcaggcgcagagtgaccgtaccattctggcaaaacagctcggtatttccgagcatcagctttcctatatcacacacagcaattccggcgaggggctgttgttctatggaaatgtaaccattccgtttgtggatcggttccctcgcggagaaatctatgacctgctgactacccgcccggaggatatgaagaatgaaacgaaaaacgaataaaaccaaggaggaggcttggtcgcagaccgcccacgcccctgacggggaacagcccgggccggaggcttccgacacttcgggacaaagtgtcccgaagtccaagttccgcaaaaagagccagcaggaacaggctgcggcggcaaagctccacatggagtcccaaggcgaaaaactggaacaggcccgggagaagctggcaaagcaaaagccgccgaaaaagcccggcccggtaaaacgcataggccgtgttgccagcggttccgttcacagcttcgtgcatggcaagatttttgaagtggaacaggaaaatgtcggcacggaaggcgcacaccgttctgagcttgtgggagaaaccgcgctacggcatggctctcgctttgtgcgccgtaaagtccgggaacatccggcaaaagtggtacgcaaggccgaggcccgctataccaagtacacagcggactaccattttcacaccgccgcacaggagcacccggagctgacgaaaaatacccttacccgctactggcagaagcaacggctccgcaggcaataccgcaagcaggcaaaggaggctgcaaagcagagcgcggctgcggctgggaaaactgccacagccacagaacgcctgactgcccgggcagtggaatttgtcaaaagtcatcccgcaggtgccgtgattgcggtgctctgtgtgttactcctgtttgctatgcagtcctgttcctctaccatgcttatgctggggaacgccggggccggtgcattaggagccagcacctatccttgcgaggatcgtgatatgctggccgccgaagccgcctattgtgcgctggaagatgatttacagcattatctggacacctatgaaagcacccacgactatgacgaataccacttcgatctggacgaaatcgaacatgatccctatgtgctgctttctcttttgtgtgcgctccatgagggacaatggacaataggcgaggtacagggaacgctgcaaatgctctttgaccgccagtacattctcacggaggatgtggtggtggaaacccggtatcgcacagaaaccgacacatggacggacgaggacggcaactcccatacggacacctatcaggtgccttacgattattacatctgtacggtcacgctggaaaactttgatttgtcccatgtacctgtgtacgttatgggcgaggatcagctttcccgatatgccatctatatggcaacgctggggaaccgccctgatctgttcccggattctccctatgtgaacaagtacattaccgggaaacccggtgactacgaggtgccaggagaatatctggacgatgaaatctttgccgcgatgcttgccgaggcgcagaaatacatcggctatccctatgtgtggggcggcagttctccggctacttcctttgattgctcgggctatgtttcatgggtcatcaatcactccggctggaatgttggcaggctgggagcccaggggctctataacatctgtacgccgaccagctctcccaaacccggtgatctggtgttcttcaaaggcacctatgacacgccgggcgtgagccattgcgggatttatgtcggtgacgggaaaatgctgcattgcggagatcccatcggctacgcaaatttgaatacaagctactggcaatctcatttttacgcctacgggcgtttaccgtgacaggaggttttgaaatggcaactaccaaaagcatgaaaattcaggccgagattgataaggtcaaggccaaaatcagtgaacagcaggcccggctcaaggagctggagcaaaaaaagctggaggcggaaaacagcgagatcgtggacattgtgcgcggtatgagcatttcccttacggagctcccgctgctgtttgaaaagctgaaggacggaggtactttgggacaaagtgtcccgaagtccgaagaagaaaagaaggaggaaaactgaatatgaaacactttcgtatgttggcagcggggctttgctccgccgttcttttatgcggctttgcaatcccggcctatgcctattcggacggcgggaatgaggaaccgcctgttgtggaagaaactccggccccggagccagcgcctaccattaccccgggcgagggcttttcggaggatggaaaccttgtgacccgcgatctgctctacgatgccgcaaccaacaaacagttcatcacggtggaaaccagcggcggcaacaccttttacattgtcattgactatgacaagcctgtggacgaggacggcgaacagtatcacacctactttttgaacatggtggatgaagccgatctgctggcggcactggaggccgctggcggagaacttccggcctgctcctgcacagaaaaatgtgcgcccggagccatccatacggattgcgaggtctgcgcggtcaatatgaccgagtgtgctggcacagctcccgaacccgctccggtgacggaacctgcggaggagccggaacccgagccccagcagaaaagtaataccgggacgcttctgctgattttggctgtggctgttctgggcagcggtgcaggctggtacttcaaaatttaccgcccgaagcatgaaaaagctgctgtacccgaagaggattacagcgaggaactggctgattatgacgatcccgaggacgatgggccgccttgggacgaggacgataccgaaagcgaggataatgaatgagatttaccaacaacccctatgagggatttatgaaagaaaaaagctactttaagggtgtgccgcccagcctgccgccgaagggctcccgttgtgacggctgcccttactggcgcgggatcggctgcgtgttctgctaccgggagcaactcaaaccaccgggcaacgggaggtgatgctgtgggccgagaactgacccggacagaaaaaacggcaatccgcaggctggtatcaaaatggtgtgccaactatgaccgggactgcggctgcctgccgctggattgcgagtgctatatgtttgggaaatgctggacgggggcttattgccgctacttccgcgaggcagttctgccccttgatccggcgctggaggctgcgctgctggcagaagggccaaggccggatttcaaggtttgcccggtatgcggcagagccgtggctcctgatggacggcaaacctattgttcggcggcctgtgcaaaggcggcacaccgcagacagcagcgggaatatatgcgaaaaaagcggggctgatgtgttgacaattaggacaccccaaacccgcctgtgacaaggctttttaaggcccttttctgcgggaggcgtatgtttctacgtctgcccctgtttccgtgagatgctgtcaacattttagctgccggggctttgggacaatttgtcccaaagttccggcttttgtggaaggaggtactatgccgaaatattatccgatcaatgaagaagccgcaaagcgggcaaaggatatgaacagcttttctgactatcagccgggctccgctacggcgggctaccgggcaatggtcgatgaagcgtatgcggcggcagaacgccagaaagtccgtgtcgatcccatgtaccacgataagattgacgcgctggtggatcgctatgcccggaaacttgcggaaaatctgaatgaacgcaatgtgattgatgcccgggtgccctctattctgatctccgggggcggcaatttccctgtgacaaaaaagcacaagcagaacgccgcccgggatcgcaactatggagagtatgcggagatttcaaagctgcttgataaaatccgctctgttggtatgggtgggatcagcgcagacgatgatcttgccgtggaaaaactgacaaaaaagctggaggggctggagtcccagcagaccaccatgaaggaggtcaatgcgtattttcggaaacacaaaacgctggacggttgcccggagcttacgccggagcaggcagaaaagctcaaggcagatatggcgcagtcatggcacttggacaaaagtaagccgtaccccgcctatctgctttccaacaacaacgccaacatccgccgtgtacgccagcgcattgaggaactgagcagccgctccgagtttgcaggctggacattccccggaggcgaggcaaaaatcaacgaggctgaaaatcgtttgcagcttatttttgaggaaaagcccgatgccaatcagcggcaggaactgaaaagcaacggctttaagtgggctcccagccaaggggcatggcagcggcagcttaaccagaacgccatccgtgctgcggcccggatagactttctgcggcccgaggacggtacaagcccctatcagctccagccgtttgtgaaaagagaaaacaaagaaatgtctcgatgatgggaggtgtactatggacaaaaatcaaggctacgccattttgaaggcggtcatgctggaaaatggacgaggatttgcattgggcgaacatcccaccgcgccatcccgctatgtcacatgggcctgctatgatgacagggacggccagcggcagtatgaatggggtcactatggaaatgaccgcaccgcgatggaacaggatttcacagaccgggtgcaggactatcagcgtatttataacgtcgggatcaggcagaccgaggctcccggcctttacaagtattattcgacccagcggcctgtggacatcgggacattcccgaagccgccttataacaagccggatgaaatcttcaattacgatcagcgcatcccggtggaaaatggctcgttcttggcttggggctatcttacctatacccgcccgctaacggaaaaacaggcatccgactatgagctgcgtcctgcgcctgataatcccgacaggccccgtccgattgccgagcagatgaaaaatgcggcaaagttggcggaggcagatcgcggctcggaggctccggctccccaacggaggcagcctgaccgtggcgatagataaggaggtacgtatatggaaaagaaacgtgaacaggaattgtctgtactggaggtgctgcgcctgcaccgtgaatttcatttgccgcaccctgttccggcagacgaacaggaaaagccgctggataaggtaaaggagccgccccgcgcctgccgcagccgggagcgtgaggagcgatgacaaagaaacgccgccgtccgatccatcttcatgtgatggtgtcggaggaggagcaggccctgattcaagaacgtatggcggaggctggcatccgtaacatgggagcctatatgcggaaaatggccctgagtgggtatgtgcttcatgttgacctttcgcctgttcgtgagctggtttcgctccagcggcgatgctccaacaatctgaaccaagtggcaattcaagccaacacctacggcgcgatttatcccgaagaactcgcagccttacagcgggactatgccgcgttgtgggggccgctgtctgatcttttgaaacagctctccgcgctggtagagctctgacccatccggggagtggttgataccgctccccggctttttctacttcgggacaaagtgtcccaaagtaaaaatactgtttgccggaaggagggatttctacggcgaccacctacatccgcccttataaaacagcggcgggaaaaagtgcaattcaaacgatggaggatcgtttcacctatggcctgaacccggaaaagctgggagccgtatcttcctatctctgcgatccgaacacggctcccgccgagtttcttctggtaaaaagtcaataccatgcagagacaggccgggccgtatctcgcggggcactgttctttcagatccggcaggcgtttctgcccggggaggttacggtggaagaagcaaaccgtatcggttatgaaacggcgatgcgctggacaaagggaaagcatcaattctttgtctgtacgcataccgataaggcccatatccacaatcacatttattttaacgcaacggcctttgaccgctcccggaaatttcataatttcattggttcgtcctttgccctgcggcggctctctgaccgcgtgtgcatcgaacatgaattgtctgttatccaaaatccgtgccagcacagcaagggtcgttttctccactatggacagtggatcggagaaaagccaccctctgccaagcagcgggtgcggctggctgttctcgccgctttggagaaaaagcccacggactttgccgactttcttcgtctcatggaggagtccggctttgcggtgaaacatgggcggggcggtgtcatctcattccttgcacccgggcaggaaaaaccgacccggctccgggcttctacacttggagttggatttgacccggaggacatcaaggcggtaattgccggggaacgtccactccccgaactgcccgaggagcccacggttccgccacggcgagttaatctcatcatcgacattcaagagcgtatggcccaaggcaagggcccggcctatgaacgatgggccaaggtctacaacctaaaacaaatggccgccgcgctccagtatttgcaggagcatcatctgacagactatgcggcactgacggccagcaccgaggctgcggtggatcactttcacaagctgtctgacgagctccgcacaacggaggaggctctttccaaaacctcggagctgatggctgccacggtggactatgccaagactcgcccggtgtttgatggatacaaagctgcgcggtacagcaaaaagtatctggcccagcacgaagcggagcttgccacttaccgggcggcaaaggatactatgaacaccatactgaacggcgcaaaactccctaagattgaaatactaaaaaaatcccgccgtgagctggcgggacaaaagaaagagctttatgcagaataccgggaagcccagcggcaaatgcgggaggccgtggcggtaaaagcgaacattgatcatctgctcggcataacagacgagcgtgaaaataaggcccaggaacgatagtgacgggccgcagactacggtgcagcgcaccgggactttgggacaatttgtcccgaagtacagcgggtttggggagctccccaacaagcatttttgcgggccctgcgccctgcaaaaatttcggagtgtggccacacccgaattgcttgccaaaacgcgcaacccgcaacatggcgcaaaaaacggaggttacgctttcttttacgtttcctccgtttctttcgatgctttcattgcttggattgtagcttcaacgattttcaattctctttcgtccaaggcgttcaacatggcatcaatccgctttctgcactcgctcccgctattttgggacgggtaaaagtattgatccaccgatatatcaaacattgtgaccatctgataaaaggtgttgaggcttggatgctggccgtcattttcgttatacataatggtacgcggagcgcggtcaacaatataggccagttgctcctgtgtcatgccgctggcttctcttgcacgcttgatggcgagccctatatcgtgaaaatcaaagcgtctttcatctcgttctatcttcataacatcacctgatatgattttacatttcatgtgatattatttgaacgattgtgtatttcatactactgactatttaatttcatattcttttcttcccaaacttgtattgttcgagtcgaagaactataatatactctatggaggtgcagaatggattatatgacactaaaagaggccgccgaaaaatggggcgtgacacctcgtagagtaaattactattgcgctgctgggcgtatccccggcgctgtaaagatggcaactatctggctaattccaaaggatgcggaaaagccgattgatggtcgaacaaaacaaggaaaggcagaaaagtatgagtaatatattacttcttgaagatgatctaagcctgatcaacgggctttcttttgctttcaaaaagcagggatttgaattaaatatcgccagaacgctcaaagaagcggagaaattgtggacagacggaaaatatgatttgttggtgttggacatatctctgccagatgggtctggctttgacttttgcaaaagagttcgacttacatcaaaggtgccaattatttttctgacggcttcggatgaggaaacaagtattattatggggctggatattggaggtgatgactatatcacaaaaccgttcaaactgggggttctcgtttcaaggattaacgccttacttcgacgtgcaaattcttttcaagcagcagacacagaattgcagtcgaatggcatcaaggttcttttgctgcaaggacaggttttcaaaaatggggtgctgttggatttgactgccgcggaatacaagctactgtgcttgtttatgcgaaacccaagcatggtgctgacaaagggacaaattttagataagctatgggattgcgacgggaattatatcgacagtagtacccttacggtctatatgcgtcggcttcgtatgaagatcgaggataatccaagtgaaccacaaatgctcctgactgttcgaggtatgggatataaatggaatattatcgggtgaggtgcagaatgaagatactggcaaataaagaaatcaaaaatctatttctttcgctttcactggtttttgggattacatttctcttagccgaggtttttctgtggctgtcatatcgccggctttctctgttattgctaatcctttttctattggctggcggtgctgtatgggcagtctgctttgtatattttaatcggcaaaatcagatcatggagcaggcgatattacaaatcaatgcgtatcttgatggtgatcgcaatgcccgtattgaatgtgacaatgagggcgaattgtaccgtctgtttcattccatcaattctttagcggcagtgttaaatgcccatgcagataacgagttgcgagagaaagagtttttgaaaaatacaatctccgacatttcacaccaactgaaaacaccactggcagctctgaacatttataacggactgcttcaggacgaggatatagaagtgtcctctgtgaaagaatttgctaatctgtccgagcaggagttggaccgtattgaagtgctggtgcaaaaccttctcaaaatcacaaagttggacgctggttctattgcatttgaaaaggaaatagaaaatgtagcggatatgatgcaggatttggagctacactttgcatatcgtgccaagcaggaacagaaagaaatcgtattatctggtgcagatgatatttctcttttctgtgaccgtgattggttgggcgaagcgattggcaatattgtaaaaaatgcacttgaccatacaggaaagggcgataccatttacatcaaatggacggcactaccctccgctgttcaaatcacaataaaggataacgggtgcggaattcatccagaagatttacaccatatcttcaaaaggttttatcgcagccgtttttcaaaggatacacaggggatcgggcttggcctgccgttggcaaaagcgattatcgaagctcatggaggcctaatagaagtggaaagtgaattaggaattggaacgagttttataatgaacttcccaattcctacaaaattgtaggctggttgtagggctacagtaatattagggtgctattctttccatcgtaaacaggaacgaaagtttacccgtttacgacagcaaaatcattgagaaagaggtgtttgcacgatgaacttattagaagtcaaaaatatttgtaaaacctatggcagcggagaaaccacagtcaaggctttgaaagatgttagtttttctgttcccaaaggagaatatgtggcaatcgttggagaatccggttctggtaaaagtacgttgctgaatatgatcggcgcattggacacgcctacgtcgggtaaggtattgattgacggcaaggatattttttctatgaacgacaagaagttgaccgtcttccgtcgcagaaatatcggatttatttttcaggcgttcaaccttgtgccagagcttacggtagagcaaaatattatttttcctgtactgcttgactatcagaagccggacaaaaaatatctggaagaactgcttactgttcttaatctgaaagaacgccgtaaccatttgccgagccagttatccggcggccagcagcagagagtggcgattggccgcgcattgattacccgtccttctctgattctggcagacgagccaacaggaaatttggactcacaaaacagcagtgaggtcatagcattgctcaaagaaacatcgaaaaaatacgagcagaccatcattatgattacccacaaccgcagtattgcgcaaacggcagaccgggtattacaggtatcggatggtactttgactgattttgggaggtgccgtgaatgaaaagctatcttagtcttattcccatctccgctaaagttcaccgccgacaaaatcgtatgacgctgctttgcattgtatttgctgtgtttatggtaacagcagtattcagtatggcagaaatgggttttcggatggaacaggcccgattggttggtaagcatggaagtttctctattggagacttgctcggcagttccatggggcaaacccttctttctgttgcggttgttctgttcctgctgattttgattgcaggcgttttgatgatttccagcagcatgaacagcagcgttgcccagagaactaaattttttggaatgatgcgttgcattggtatgagtaagcagcagattattcggtttgttcgtctggaggcattgaactggtgcaaaacggctgtacccatcggtcttgttttaggggttgttactacatggggactttgcgcggtactgcgttttgtagtcaaagaagaattttctgatattcctctctttggcattagtatttttggcattgcttgcggtatctttgtgggactgattactgtactgattgccgcaaatgctccggcgaaacatgccgcgaaagtatctcctatcacagcggtgtctggaaatgcagaccacggaaaaacaatgcatcattgccagtatacaggattcggaaagattgaagcgcttctcggtatcgaccatgcggtctccgggaagaaaaatttatttctgatgacaggttcttttgcacttagtatcatcttatttttgagtttttccgttatgatcgattttgtggattatttgatacctcagtcagctgccacatcagatattgatattgcaagtgatgacggtaatgcgattcctcgggaattgcttacatccatccgtgcaatggatggagtgagagaggtttacgggcggcgtagcgcgtttgatgttcctgccagattaaatagcgataccggattttccggtacaaccgacatgatttcttatgatgattttgatttacaatgtctgaaaaaagacagtgctttgaaaagggggagtgatctgtccaaagtttttggggacagcaattttgttttggcaacatccgatcaggacagcacatggaaaatcggtgacactgttcagattggggatgaaacccttaccatagccggactgttaaaaaacgacccatttagtgagaatggattgacaaatggaaagctcacattgattacctctgatgaaacatttgtccgtttgacaggagaggaaggttattctcttgtgctgatacaaacaacgggagatgttacggacgaaaatgttcaggcaatccagaattccgtagatcaaacatatagctttcgagataaacgcgacgagcgcactacgggaacttatatggcttttgttttctgtgtttatgcgtttttggcaattattgcactggtaacggtaatgaacattgtcaatagcatttccatgagtgtgtctgccagaatgaagcaatatggagctatgcgggcagtaggaatggatgaacggcaaatgacgaaaatgattgcctgtgaagccttcacctatgctgttttggggtgcgttgttggttgtgctattggcttgccgcttagcaaatcgctgtatgatttccttattgcagggcattttccatctgctgtgtggcagttcccaattatctctttgggcattattcttctgtttgtctcgattgcggcaatcgcagctgtatatgctccggcaaaacgaattcgcaatatgtcgattactgcaaccatcaatgaattatagtttcatatgttaatctgccgcgcgacggcaaaagaaaaaaagccgtcgcagagcagacacattttcacgcgcctatgaaacggcggctttgattttcagagccgccgtttctttgcgtttacacaatcctatgacgacttgcagggacacggtagccgattggaggttaatttaccgtgtccttctttttgtttcgcagtatccatgatctgcaccagctaaaaaaagcgtagcccctccatcggagcagtccggctttgaatgtgaaattaaacagtacataaccgataatatattttcatgcgcttgtgcggctttgtgtcgcgcaggcgcattttgctttccagacttcgagacaaagtgtcccgaggtgcggtgccgttctccgccgttactccatttcgtttccgaccaaccccgaacaaactgaaatggaggattttacgatgactactatcaatctgaaagatttttattattggtacacgcaggatcagcttatcgaagtttctgacgaggtggccgaggtattcaaggccgatgcccgctatgaaatggcctaccagcggcggctctcccggcacaaggcgcagtattctttggactgcgatgacgggattgaatattccgcttgcctgcatgagccgaccccgcaggagctccttgaacgaatggaaacctttcttcgtctgtggaacgctctcaattctctgccggagattcagggccgcagaattgacgcacatatcattcttggcaagtcgattaaggaaattgccgaggccgagggcgtacatgaggagtctattcgccagtcgatcaagcgtggccttgaacgcatgaaaaaaactttttgattttttcatcttaacccacttggaattgatgaaaaaatgtctcggtttatgagaggaggttttcttcctaacgcaagggaataacggcaaccctgagtaagttcggggagccagacggtgggtgcgcggtgacatttccaaaaagagattgagcgaacaacaccaacatcgtaaatgagcccggccatcccaaggccatgatccggcgctgaacaggttggctgcctgttcctccgggcgtgtcgctttacttgcgttgagagcgccgcacagaaaataaagattgtctttggacaggccaagtaaatatgtgcggcgctctctaatattcaaaaactataataaacctcgagacaaagtgtcccaaggtggagtaaggcaacaggccagcatcccagtggtgctggcctgttgcgtttccctaccaaacagagggaggcgttctatcaatctgcgaaggaggtttaccgtgaaattaactacacaggaacttgaacaaatgagaagcgttgacattggcgcggtggctgccgagtccctgcctgatgtgagcggtatgacctttgacaatgcgctttcccgaaaggagcgcatcactcgatttttgcagactgtcaaaaatccatactgcttttgcatcggtggtgttggcgtgaaaattgaatttgctgaaagcgggccatctctccaagataagctgacggatttcctgctgcggcaaagaagcgggctgtaacttcggttacagctcgttttgcttcttcgagacaaagtgtcccgaagcggaggcatccttgttgtcctccccggacagagttataatataagtgtaatgtgatagggaaggaggaacaatggcacgagcaaaaaacagagggtatcagcagagtttctctccctcttacacaatccgccgctggcggctgggcatctatatccggctttcaaaggaagatttgaaaaaaggaaaagacgatagcaacagcgtaaagaaccagcgtgacctactgaacgatttttaccgacgaaacattgacgagtttgaaagcatcacggaatatgtggatgatggtcatactggaacggacgccaaccgtgaagattttcaacggctcttggcggatgtcatgagtggtaaaatcaactgcgttatagtaaaagacctgtcccgcttcgcacgaaattatagcgatgccggaagtttgatcgataacctgtttgttcaaatgggtgttcgctttatcagccttgctgagaatgtggacagctacaagaaccccgacagcgtttcaaatatcatcgttcccattacaaacgtgatgaacgataattactgctatcagacttccaaaaagatccggcaggtatttgattacaaacggcgcaacggccagtatatcggagcatttgctccttacggctatgtaaagcacccaaaggacaagcacaggctgattgttgatcccgatgctgctgaaaatgtcaaactcattttcacaatgcttattcaagggtcatcaaaacgtgctatcgcgctgtacctgaacgaacacggcgtaccgagcccctcggcttacaaggtacaaaagggcttgcctgtttcgacaagagggtatgacgatcctatgtggggagtccgcatgatccactccattcttaccaatccgacctacaccggggatttagcccaaggccgaagccgggtgaaaagctacaaggtacaccagattgaagctgttccacgcgaggaatgggtggaagtggctggaacgcatgaggccattatcgactatgaaactttcgacaaggtacaggctctcttacagcgtgatacccgtacttccccgaaaggccgtgaggtacatttattcagcggctttctgaaatgtgccgattgcgggcgggccattacccgatgcgttggcaagaacaacaatgtatattattcttgctcaacctacaagaaccgttcccggacagcctgcaccatgcactcaatcaagcatgaacggctggaggctgctgttttgttcgctgtacagcatcaggtacatttggctgtttcctactcggaaatcgtcacgcagatcaattccgctccaatcaaaaaaagccagtcctaccgactggacgatctgatagctgcaaaagagcgggaactgacaaagataacacgctacaagcaatctctttatcaggactggaaagacggtgaaatcacccagcaggaataccgggatatgaaggctgactatgaacggcagacttctgatatttccgcggtgcttacccggctgaacgctgaacgcgcagaactggcaaacggtgtggacaacgagcatcctgcactggtagcctttatgaagtatcagaacattgaagccctcaaccgtgaaatcttggttgaacttgtggactatatcaaggtctatgaaaacggcaatatcagcgtgaaattcaaattcgctgacgagctccgcaagattgccgagtacattgaaatcaacactacggaagataccgcagtagcgggctaacccccgctacaaacccctttgacagtgtgttttcctaataggcgctaatcatatgctgttggtataataaatagtgtgttgagtacacgagtccgcaaatgcgcggacgatatttttacacaaaaatgtacacgtgtacgcaaaacagaaaaaatcacaacaaaacaatgtatggggaggaagtagtgcaaaaatgcggacgatactgcattttgcacagggctgtttgatgcggcagacaccacaaaatgagcccttatcgcagagcaaacgagatggaagacacgttacgggtgcagattcattgcccgtgcaaatcagaggttgcatctgtggttgcctcgacacaaagtgtctgcagaatggaggataacatgaaaaaaagagcaatggcgggattactggcaatgacaatggcagcgaccatgtttgcagggtgcggcagcacagcagcagacagccagacagcggatgcacaggggagtgcaggcacggcaacagaggcagcaaagacagaaaaagacagcggaagtgctgcgggagaaggaatcacattgactgtgtgggcaccatttaccggatcagacggagatgtgctgcgtgaaatcatcgacaactacaatgaaaccaatacggacaatattacggtgcagattgatattatggacaatgataccttgcagacaaaatttgcaacggcagtatcgaccggtacaggaccgtcgtttgtgctggtgggcattgagtatcttcatcagtatgaggagaatggactgatcgaggatatcagcgatttctgggatacgatgggcattgacaagagtaatttctatgaaaatgtacttgcaaaatcctacatagacgatgcgctctacggcgtaccaatgcagtacaatgtgcagtatctgtattacaacaaggatcttttcacggaggcaggtcttgatccggagaacccgccgaccacgctcgatgaattgcgcgaggcggcgatcgcctgcaccgatccgtctaagaatcagtatggactgggacttccgaccgattacggttattactgcgagtacctgtgggcgaacggcggagatgtcatcaatgaggatgcaacacagaaccttttaaattccgaagaaaatattgcaaccctggagtggattcagaagcttgcgacggaggatggggtatccccggagggactcaccgcagcggatgcggacacgatgttccagtccggccagcttgcaatgtataccagcggtccatggaacatcaacgggttgacacagcttggtttgaattatggaatcacggcgatcccgggcggaagcgacggcgcgtactccccggagggcggatgctcttacatgctgacgaaaggggccgacgaacagaccaaagaggcagtgtataaatttatggcatactggctgtctgatgatgtgttaaaagagtggtcgaaccggaacggcttcccggtatggtcttactctgttcttgaggatgcggacattcagaacaacgagatcttaagtgcagtatccaaggcatccgagatcggacgtgactggcatctgggactggaatgcggaagcatgattgacaatgatgtcatgaaaccgatgatggagaaaattttatccggggcagacgtgacgcagagtgtacaggaggcttcggacgcgctggacgcggtgatctccgactgatgtctgacggtcactgacgcaaaaatagctgcaagctgtaaaggatggaaattatgaaagtaaaaaagagacaacaccgtatggagcatcaggtgaaggcgtatgcgtttatcgcgccttccctgctcatacttaccgtatttgtatttataccgctggcgggagcgatcgggatcagtctgatgaatattgatatttatatgaaaaatatctcgttcgccggaatcgccaactacatcaaaatgtttcaggatgagcgtgtggcaaatgctacgtttcatacattttatttcgcactgcttgaggtacccctccagatgatcgtggcgttgctgctgctcatgtttatgctgcgcaatacaaaactgcacaagcttttgagaaccgtattttacctgccctatgtgtgttctatgacggcagtcagcatcatgtggtcgatgctgctcaatacgcactacggaatgctgccatatctgcttggaaaaatcggtatcacgatgccaaacatgctctcaagtacgacatgggcgatgcctacggtgatttttgttacggtgtggaaagggttcggatatacgcttaccatcctttcggcggcggcgctcggcgtctctgagtcgttatatgaggcggcggagattgacggcgcgaccgggctgcagaaatttttctatgtcacaatacccggtatacgggatacgatcggtttttgcgtggtgacgacgttaattatggcgctgcaggtattcgatcagatctacgtcatgacgggaggcggcccgcagtacgcgaccgagacgctcgtgggttatatctacaaccggggatttcagacagcgccgtatgatctcggatatgcgtcagcaatcgccgtttatttgttctgcatgattgcgattataaccgtgatcttaagaaaatatgctttcccccagggaggtgacgagacatgagaaaaataagtgcgcagcgggtgatcggaacattggtacttctgttgtttgcagcgctggtgctgcttccactgttctggctcggcgtatccgccttcaagtcggatgcggacgtcatcaagtggccgccaatctttttcccgacagagtgggtcacaacacagtttgcctatgtgtggaaagtgctcccgattgccagaatgctgcttaacacggttgtgtttgcagggggtgtcaccatcatcagtctgttttttgattctatggcagcatatgcatttgcccgaatgaaatttacaggaagaaaactgctctttggaatcatcctgctcacgatgatgattccgtttcaggtggtgatgattccactctatatggaagaatataagcttggaattttaaatacgttcttaggactgattctaccacgcgcagcgagtgcctacggtattttcatgctgacctccttcttctcgggcataccaaaatcgctggatgaggctgcgaaaattgatggtatgggagagtggaaaatatatctgaaaatcattctgccgcttgcaaagccggcacttgtgacactgggaatctatcatttcatgaataactggaacgatctgctttatccgatgatgctgacaagttcggtggaaatgcggacgctgtcagcaggacttgcaattctggttggaagtaattcgatcaaatatggtccgacacttgctgctacggtgattgcgattctgccgctgttactgctgtttttgttcggacagaagtttttcatggaaggaatcgcaacatcgggaatgaaagaatagaggcagaggagagagaagatgagacatgtgacaattaaagctgatacggcatttacaaaaggcaggattgacgaccgtatctacggctccttcgtggagcacatgggaagagtggtgtacaccggcatctacgagccatcgcataagactgcagatgaaaacggattccggggcgatgtgctgcagaaggtaaggcagatgggggtcacggcggtgcgctatcctgggggcaattttgtctccaactatgactggcgggacgggatcggacctgtggagaaacgcccgaggaagcgggatctggcgtggaaaagtattgagacaaacgaggtcggtctggatgaatttatgaagtgggcggatgcggcagaggttgcaccgatctatgcagtgaatcttgggaccaagggaatcgaggaagcgcttgcggtgctggaatattgtaatatggagaccggcacatactacagtgatctccgggcggcaaatggacatgaaaagccgtacggcatccggacctggtgtctgggcaatgagatggacggagactggcagatcgggcacaagacggcggaggaatacggcaggattgcctatgagaccggaaaggcgatgaaaatcttagatccatccatcgagctggtggcgtgcggaagttcgatgtccacgaatccgacgttcggtgactgggaacagaccgtactggaacattgttatccctgcctcgattacatttccctgcaccagtattacgggggacaggagaagggcacgtcagagtttctggcacagtcgctggatatggagcgctatatcgagacggtcttaaacatctgcgactatgtgagggtaaaaaagaaaatgtcacataagatcaacatctgttttgatgagtggggcgtctggtcgatgagcgacgtgcaggtgcagaaatcggtggaggatgcaccgtggcagacggcacctgcgatcagcgagcagatctataccatggaggatgcgcttctgtttgcaagtatgctgatgaatttcataaaacgggcggatcgtgtgaagatcgcctgccagtcgcttcttacgaatatcagctcctgcattatgacagagaaggacggcggtgtgtgggtgcagccggtgtattatccgtttgccctgatggcgaagtatgcgcacggcgtgacgttagatacacggtatacgggagacacctacgcgtgcagcacgtttgagacggtaccctgtgtggatcatgtgctcgtctatgacgggcaaaagcatgaagtgacggttttctttgtaaaccgtatggaggagagtgccgaggcgaccgtttctttacagggcatggagccggaggcggttttaaaaagtattgcactgtttcacgaggataagaaagcgacaaatcaaaaggaacatgactgtgtaacacctgtggaactggaaaacgtctcctgcagcggaaacgaaatttcagtggaacttgtacctctctcttttcaaatggttcagattcgattaaaatagaagaaagttttttgaaaagaaagaaaacggggagcaggaaaatatggcgatcacgacaaaagatctggcgcagttgtgcggcgtttccagaacaacgatacaccgggcattaaatggaaccgggcggattaagccggagacaaaggagatgatccttcaggtggcaaaggaacacggctaccggccggatctccttgccaccggactggctaagggacagacgtacaacatcggtgtcgtcgtgctggacgtgaagaaccgctattttgcccagatgctctcgacgatcagcacggaggcatatgcccgcggctacggcgtcaacattacgctgcacggcggggatgccgggacggagcgcgagcagctgacaagacttgcggattaccgggttgacgggatcatcctctcctcggtcaacgagggggaggcgtaccggacattcctggagtccctgcaccgcccgattgtctctgtggataaccggattgcggacggcatcccgtttgttgggatcgaccagcgggcagcagtgcgggaggcagtgcagagagcggcagagaagggctatgagcgcatcgtgtttgtctgcccgccgttagatacaaaaaaccggcagaatctgtatgttcacaaggagcgtctgctggggtatgaggaagagatgaaacgctatcccgcgctccggccggagtgtattctctcctgggattacctgcagaaagtggatgccatattaaaagaaggaaagcggacggcgtttgtctgtaccgcagatgagtatgcacttgagatcatgaaggatcagaagcgggcaaaaagaaaggcgccggtggattacggcattaccggatttgacaatatcgatacgctggcatatgtgacaccgcagctttccacgatctccaatgtggtggatgaggtggcaaaaagtgccgttgagatgctttttgccatgatagacgctgaaccggaagtggagcagatgacaggagacagtcagcggattttacctcatcgctacctggagggagagacgctgtagtgacagaaggatatagtatataatcagaatataattcaacaattcggttaaagctgcggaaatcagactgcctgtccgaggcaggtgcggatgtcgtccctggcgttgctgatggattttaagtggaacgtgtctgtcaggtattgcaggacattcggactcaaaaaggcgggcagagtgggaccgagataaatgtcatggatgccgagacttaacagagcgagaagatcagcgacggctttctgttcataccaggaaataatcagcgagagcggaagaccgttgacatccgtgccaaatgcatcggcgagagcagtggcaatgcggatggcagagtagacatcgttgcactgtccgatgtcgaggagcctcggaagacccgccacctccccgaagtccagcttgttgaagcggtacttgccgcaggcgagggtcataatgaggcagtcctgtggaaccatctcggcgaattcggtgtaatagttgcgtccggggcgcgctccgtcgcagccgccgatgaggaagaaatggcgcagttttccggattttacggcatccacgatcgcatcagcatagcccagtgtggcgtggtgaccgaagccgacgaggatttcctgtacgtcctggtcttcgggatagccgccgagttccagtgcctgctctatgatggcgctaaaatccttttcgccgttctcgtttttgccaatgtgcttcacaccgtcccagccgaccacatttgtgctgtagatgcggtctttgtaggagtcgcgcgggcgcatcaggcagttggtggtcatgagaatacagccgggaagattgtcgaactgtttctgctgatcctgccaggcaccgccgaaattcccggcgaggtgcggatatttgttcagccccggataaccgtgacagggaagcatctctccgtgggtgtagatatggatgccggttccctccgtctgctttaaaagcatttcaaggtcttttaaatcgtgcccggagacgatgataaacggaccttttttcaggtggacattgactttttgcggggctgggttctgatagatggtcgtgttggcttcgtccagttttttcatgacttcgattgccatctcaccggtgcgcatggtaaggcggatcagttcctcgaccgacagccggtcgtccgtgagggcttccagggcgagaatatagaaatcatccgcctcatcgctgtaatagccgagctctctcgcctgatgcccgtaggcgctgatgcctttgagtccgtagagaacggtctgacgcagggaccggatgtccggatcgagcgacttgtcatacatgataccggcgatgggcgcgtcgcgcagcatctcggttttggtctgcggaagatcgtaggtggcgtgaagcgtgggctgactgggagcgcctgcgtaagcccggagttcttctttgatgcgctgggattcgcgcaaaagttcgacatgtacttccacgtcaaaattaacgttcgtaagtgtggtaaatagcacattttcgatgaagctgacaacacttttatccataggagtgcctttttcgatcagaggcctggcatagcagctgatgcccttgatctgaaagattaaaagatcctgcagatttgcgacttcgggagtttttccgcatacaccgagcttggtgcagcctttctggttagcagtctgctcacactggtagcagaacatttcgtaatcgagttccatattatttcccatgttgatttctcctatttttattgatataccgggtaatccgtattgcgacaggcacagtatgtgcagaatatggaaaaaagatgcggcagagccggatataatgagaaaacttatcagcaaccccgttttcatttcagatcgcagtgctataataaaaacaggattagatataactaaccccgaacatgcaacgatcagaaaggatggcattatgggaagatattatcgattatcaaaaaagctgacagaggatgagagcagggaagtacagcgggagatgagagaaatcgctgacgtggaggacgtctcgatcaaagcagacgagcggatgctttttgtcgtcacaaaggacggacagttttcggatgtgatgagccgggcagtcaatatctgcagccgcgtggcaaacggagcggaactttcattcgcacgttttgcggaggcatagattcggaagagagcgtgccgacagacaatacgcggactttttagtgttcctaacatcaccgcttcacagacaatataaaaccgcgcgaaccgaaactcgttggcatctgctattgaaagcatggcagatgccgactcagacatcggcttcgcgcggttatgttttgttcattagtgatgtaaggaacacacaaaagtccttgaattgtctgtcggcctgcggacacacccgcggagtgctcaaaacttggaaaaacacggattatcgcagatgtaaaaagcggcagggttagaaattccgtattgtgcgatccgaatttccccgcctgcttctatccggaatgcggtcgcacgccttctgtaaaaatgagaaacaatctcaatagcggggcgatttctctcttgctttcttcacggtttcgttctagaatgtggttgaatcatatcctaccttacaactaggatatgaaagatgtgtgggagcgtcgcaaagaaaaccaaaagggcagcggagggaatcgtgaaagaggattccgtctgcagaaaacgcttcagaaacggaggcagctatggcagagcagattttacaggtagaagggcttacggcgcgcgtggaggataaggtgatcctgcacgaggtcgggcttacgataaaaaaaggagagacgcatgtgctgatgggaccgaacggtgcgggaaagtcgacactggggtatgttctgaccggcaatcccaaatacagcgtcacagagggaaaaatccttttcaagggaaatgacatcacggaggaggcggcagacaagcgcgccaaggcgggaatgttcctgtcgtttcaggaaccgctcgaggtgccgggactctccctcgagagctttatccgcagtgcattgagcgagcagggcagaaataaaatgcgcgtctggaatttcagaaaagaattaaaagcggcaatggaagtgctgcacatggatccctcctacgccgggcgggatttaaacgtgggattttccggcggtgagaaaaagaaatccgagatcctgcagttgatgatgttaaaaccggatcttgccattttagacgagacagactccgggctggacgtggatgcggtgcggcttgcatccgagggaatccgcgagtaccagaaggagaatccggacggcgcacttttaatcatcacgcacagcacgcgcatcctggacgcgcttcatgtggacgcaacccatatcatggtgaacgggcatattgtggcatccggggatgcatcgctggtggataagatcaaccgcgaaggttacgaggagtatgagaagctggcacaaaaaggagaggatgagcggtgaaagagaagacatacgtagaagacattgaccgcagcatatacgatgtgaaggatgaggaacgggatgcttacaaggtcgatgagggactgaccgaggcgatcgtcgagcagatctcccgtgaaaaaaaggatccgccgtggatggaactgtttcggcttcaggcactgcagatttacaatgagatgccggtgccggactggggaccgtcgattgaggggctggatatgagccatatcgtgacgtatgtgcggccgaatacaaagatgacggcaaagtggtcggatgtgccgcaggacatcaaggacacctttgagcggctcggtatcccacaggcggagcgcaagtcgctggcaggtgtcggggcgcagtatgactcggagctggtgtatcacaatgtgcgggaagaagtggcagcccagggcgtggtctacacggatatggagagcgcgttaaagggcgaatacgcggatatggtgcaaagccactttatgaaactggtcaaaccgaacgatcacaaatttgccgcactgcacggagcagtctggtcaggcggatcgtttgtctatgtgccgccgggggtgtcggtgacgattccgctgcagtcctatttccggctcaatgcgccgggagcagggcagtttgaacacacgctcatcatcgtggacaaaggggcgtatctgcattttatcgagggctgttccgcaccaaaatacaatgtggcgaacctccatgcgggctgtgtggaactgtttgtcgaggagggcgcgacactgcgctattccacgatcgagaactggtcgaaaaacatgtacaatctgaacaccaagcgggcgctggtcaaggaggggggacggatcgagtgggtgtccggctccttcggctcccatgtatcgtatctctatccgatgagtatcttaaagggaaaaggggcgcacatggaatttacaggcatcacgtttgccggaaaaggtcagaatctggataccggggcaaaggtggtgcatgccgcaccggatacctcctcgtacatgaacaccaagtcgatctccaaggacggcggtatcagcacgttccggagttccgtgagcattacaaaggaagccgccggcagcaaatcggcagtttcctgtcagtcgctgatgctcgatgacatctcaagatcggatacgattccggcgatggacatccgcacaggagacgcggatgtgggacatgaggctaaaatcggccgcatcagcgatgacgccgtgttctatctgatgtcccgcggtatcagcgaggaggaagcgcggtcgatgattgtcagcggttttgcaagcaacgtgtcaaaggaactgccgttagagtatgcggtggagatgaacaatctgattgatcttgagatgaagggcagcatcgggtaaaggaggagcttatgacaaaacagaatcagacgatcacagtcaaccggcttcctgcaaagacctggaactggctgaaaatgaatgaaaccgtgattgggatgccgcggatcgacggcagtatagcgataaaacagagtgtggcagaagcagggcaggcagaggcagagcagctgcggatggcgcagcagacggattgggataaaatcacaaccgggatgggcgaggcgatggatcagccgtcggagacagatgcggcatgggataccgagcttttgacgattccggaaaatgcagactgcggcgaaccgtatgtgtaccgttttgcttaccggagcgggcagcacgcctataaccgcctgcatatctatgccggagcgcacagccgggcaaaaataattctgctctgcgagagcgaggagacgggcgggatgatgtccgccatccagacgaaggtatatgccggggagggcgcgaaagtagaactgtatgtggtgcagacgatgaatgcggaagccgtctgcctgcatgatgtgggtgtctcgtgtgaaaaagatgccgctgtgaaggaagtgcagctggaactgggtggcgccgaggtctatacgggaacactgtttgaacttagcggagaagagagcacggcagaactcgtaagcggatatctgggcaccggcaggcagaagattgatatgaattatgtcgccagacaccgcgggaaaaagacgaagagcaatatgcagatatcgggcatcttaaagaacgaggcgaagaagctgctgcgcggaacgatcgattttgtgcacggctgtgtgggagctaagggagacgagaaggaggatgtgcttcttgtcggtgacaatatggtcaaccagaccatcccgttaatcctgtgcgcggaggaggatgtggagggcaatcacggcgcttccatcggtaagctcgacgagaacatgctcttttatgccgccacgagaggcattcccccggaggaggcacagagacttctgacactggcgaagatcgaagcgataaacagccagatcccgtcagaggaggtgcgcggcgctgttgacacttatctgaaggagcaatgcatatgacagattataaaaaagattttccgctgcttgcggaaagcgatatcgcttacctcgacaacgcggcgacagaacagcggccggcgtgcgtgctcgatgcggagcgggaattctatgagcgctggaatgccaatccgctgcgcgggctctatgagctgggcgtggaggcgacagagcagtatgagcatgcgagagagcgcgtcgcacggtttgtacatgcgaagagtgagagagaaatcatttttaccagaaatacgaccgagggcatcaatctggtggcgtacagttatgcgctgtcccggttaaagcccggggatgagatcctcgtcacgatcatggagcatcacagcaacctgcttccgtggcagatggcggcgagacaaaccggagccacacttaaatatctggagtgtgaaccggacggcagttttacggaggagaaaatccgtgacgccgtcacaccgcacacaaagcttgccgcgctgacacttgtctcgaatgtgcttggacgggcgaccccggcagaaaaactgatcgggatggtacacgaaaacggcggtgtggtactggcggatgcggcacaggcagcgccgcatatgccgatcgatgtcacggcacttgacgtggattttctggcattttccggacacaagctgatggcgccgatggggatcggtgtgctctatggaaaacaggaacttttagaggagatgccgccgtttctgaccggcggggagatgattgaccgtgtgacgagagagggagccgtatttgccgaacttccccataagtttgaggcagggacggtcaatgcgggaggcgcggccgcgcttgccgccgcgatcgattatctggaatccatcggctggaaagaaatcacggagcgcgaggagatgcttaccgcccagctgcttgccggaatgaaaaaaattccgggcgtgcatattctgggaagcggggacgaaaaggagcactgcggaattgtgagctttaccgtggatgatgtacacccgcatgatattgcatcgatcttagatgaggcgcacgtcgcggtgcgggcgggacatcactgcgcccagccgctgttggaatggctcggcatttcgtcctgtgccagagcgagcgtggcattttataatacgccagaggatgtcggacgatttctggatcagctggcacaagtcaggaggatgatgggatatgaataaccggacattttataatgaggtgctgacggatcacaaccgctatccgggtcacaaggagaagcttgcggatgcgaatctggtgcttgagggtgtgaatccgagctgcggggatgatattgtgctgcagctgcgcgtggaggatggcaggattgcggagggaacctttacgggcgacggctgcgccatctcacaggcttccgtggatatcatgctggatctggtcatcggaaagaccaaggaagaggccatgcacctggcggatctgttctttcggatgattaaagggacggtatcggacgaggaattagaagaactcgaggaggcatcggcgcttgtggacatttcacacatgccggcgcgtgtcaaatgcgcggtactcggctggcacacgcttacggagatgcttggggacgaaccggaagagaaatagaaaaatatagaaataaaaggagtggcagggatcgagtaaatctctgctgttttacaggtttttgatgccatcggttattgcagccggtatgaaccggtttataataaggaaaaaacgcagccatccggcggaggtattaaaaaccgggagcaggatggaaaatggtggataatgatgaagtttatcaataacgaaaaaatactggaaaaatacaaaaagcggtactataatgcacaataatgtaaagagcgaacaacatgttcagcaaaggatgcacgggattgtgcatagaaatggaggatacatatgttaaagtgttttgagaagatcgattggaagaagacaggaatttttgcaggcggcgtattatttggaacagccggtatcaaggtactttccagcaaggatgccaagaaggtttacacaagctgtaccgcagctttcttaagagcaaaagagtgtgtgatgaacaccgtaagcaccgtacaggagaatgccggagacatctatgcaggcgcaaaggagatcaatgaggagcgcgcagccaaggctgaggcagaggcatttgcagatgcagaggcagaagcagcagagaagaccgggactgcagagaacaccgaagaataagattttgataagaggcgagtaaagtgaagtttgcaatcaagcatgagattaaggggcggatgcggattcacgtggcacagtaccgcatgagttgtgcacaggcggatacgcttctgtattttttacaaaatgatatacaggtctcaagcgccaaggtgtatgagcgtacgggtgacgcagtcatctgttatgacggcagcagagcggaactgattgacaagctcagacatttccactatgaagatgtggaggtgccgaacgggctgatcgagaattccggaagagagctgaatgcaagctaccaggagaagctgatcggcagagtggtgagacgctatgcatccaagatttttctgccgtatcccatccgggcgtgctggacgacggtcaagtcgttccgctacatctggaagggcataaagacactggcggcacgaaagatcgaagtaccggtactcgatgcgacggcgatcggagtgtctattctgcgcggtgataccgagacggcgggatcgatcatgttcctgcttggcatcggcgagctgttagaagagtggacgcacaagaagtccgtcggcgaccttgcgcgcaccatgtctttgaatgtcggcaaagtatggctgaagaaggacggcgtggaggttcttgtcggcgcgaaggaagtccgtgagggagacgaggtggttgtccatatgggcaatgtaatcccgtttgacggcgtcgtgacagacggcgaggcgatggtcaaccaggcatccttaaccggagaatccgagccggtacgccggattagtgagaattatgtctatgcaggaactgtagtcgaggaaggggagcttaccattctcgtgaaggcggtaggcggctccagccgctacgacaaggttgtgcagatgatcgaggaatcccagaagttaaagtccgggcttgagagccgggcagagcatctggcggaccgtctggtaccgtattccctcggtggcacggcgctcacataccttctgacccggaatgtgacgaaggcgttgtcgattctgatggtggatttctcctgcgcattaaaacttgccatgccgatctccgtattgtcggcgatccgtgaggctagtttttacaatgtgacggtcaagggcggaaaatatttagaggcaatggctgaggcagatacaatcgtctttgataagaccggcacactgaccaaggcaaagccgaccgtggcaaaagtggtttcctttaacggggacagcccggatgaacttcttaggattgcagcctgcatggaggagcatttcccacattccatggcaaaagcggttgttgaggcagccagggaaaaaggtctggatcatgaggaaatgcattccaaggtggagtatgtggtggcacatggtatttccaccacgatcaacggcaggaaagccgtgattggaagctatcattttgtatttgaggatgagggagctgcccttcctgagggtacgaaggaactgttcgagagcctgccggaggagtattcccatctgtatctggccatcgagggacagcttgcagccgtgatctgtattgaagatccgctccgtgaggaggcggaggcagttatcaattccctgcgccgctccggtatcaagaagatcgtcatgatgacgggtgacagcgagcggacggcaagcgccatcgcaaagcgcgtcggtgtggacgagtattattccgaggtgcttccggaggataaagccggttttgtcgagcgtgaaaaggcagccggacgcaaggttatcatggtcggagacggcatcaacgattccccggcactctctgcggcggatgtcggcatcgcgatttcggacggtgcggagattgcgcgtgagatcgcggatatcatggtaagctcggatgatctctatcagatcgtgaccttaaagctgttgagcgacggcctgatgaagcggattcgcaagaattaccgcgtgattgtcggattcaataccggattgatcctgctaggagtcggcggcgttttacagccgaccacatcagcgcttctgcataacacctctacgctggtcatcagcttaaagagcatgcagaatcttttgagctaactgaatatgtattttgaaaagtctttacagatttgccactggcagtaaaatgcggcagaactgtgaaggcttttttatttcataggaaataccgtgatacattcatgtgtgaaagtggaactttcctatgaaagtttcagagaaaacattctgatacatttccaaaaatttacaaatttattgatgacaaaataaaaaatgtgtataataaaggcagatgtaaaaagttggcagataatagcatacagaaagagagtaccggatatgagaaaaaaatggatcagactgattgcggcagccatgggaagttttctgcttgccggctgcggtgcagatacgcagattgatgattatgctacaaatgccggagcggagagcgtgcagcagacgtcagggacggagtcggcggctgcggcagcatccgcgacggagggaattccgaaggacgagatcaaggtcggggtgcttcatctgtcagacccggcagagggaagcggatacacatacacgcatgatctgggaattcagggaatgcagcagaacctcggactttccgacgatcagattgtgcggaaaatcaatgtcccagattccgatgaggatgcgacaaagcaggcgattcaggagtgtatcgacgagggatgcaacattatctttgcgaccagctggggttacatggaggcgacagcggagatggcggagaaatatcccgatgtttatttttcccatggaaccggttatatgagcaacggcaggaatttcaataactatttcggcagaatctatcaggcgcgctacttaagcggtattgtggcgggaatgaataccacgacgaacaagatcggttatgtggctgccatggataacagcaattcagaggtgacgggaggaatcgatgcgttcgcgctcggtatctattcggtcaatccggacgcgaaggtttacgtcaaggtgacgaacagctggtatgatccggaggcggaggagaatgcggcaaagacacttctggatatggattgtgatgtgatcgcccagcactgtgatacggagtatccgcagacacttgcccaggagcgtggcgtatacagcatcgggtacaattccgacatgagcaagaatgcgccggaggcctgcctgtgcagcgttatctggaactggagtgcctactataccgcggcagtgcagagcctgattgacggaacctgggatggaagcaattattacggcggcatgaacgagaatctggtcgctcttaccaatctggcggatttctgtgcggagggcacacaggagaaggtagacgaggcgaaggaacagatcctttcgggacagaacggtgtatttgacggtgtgatcgagacaaataccggagagacggtcggtgaagcgggcaagacgctcgacgatgcgacaatcaccggcggcatcaactggtattttaagacggtgaatgttgtggattaaggagcagccggacgaaaagcgacatgcagatgcacagacgaaatggagattagtatgaacattaagaaaaagattctggggattacaattgcaccggttattatattggggttgatttccatgtttttgacaaccacaatggtacggagcgccatgctggaggagattgaggaagcacttcggggaacggcggcagccacgctcgcagcctacgatcagaatacgggagattatctccagaccagcaatggagatatctggaagggcagttataatatttcaaagtccgagagtctggtagaccgtatcaaaggcaataccggaatggacgtcacatttttctacggagatacccgcattatgacatcggcggtcgatgcaggagggaaccgcatcttaaattccaaagccggtgaccggattgtagaaaaggtactacagggcggcgaatcctatttcagccatgcggtgtcgatcgagggcactttgaactatggatattttataccggtatatcagaacggatcgaccgatgagattatcggtatgatttttgtgggaacggacaagcaggaaaaggatgccgtgatcaacaagattctgggaacaatcagcatggcggtgtgtgcggtgatgatcctatgcattgcgatcggcatgaagcttgcaacctcaatgagccgcaatatccgcagcagtattgaggtggtaggaaaagtggcggacggcgatctgaatgtctgggtagaagacaagctgctcgggagacacgacgagatcggtgatctgtcccgcgtgacgatcacgctgcgggatgccatgaaggcaactatccaggagatttcacaaaatgccaaacgcctgctcgatgcgtccgaactgctcggtacagcggcagaccagacaaacggaaccatggatcatgtgcgcatggcagtcaaccagattgtggagaattccactgaacaggcacagaattcccagaatacatcggaacatatgcgtattatgggtgagaatattaccgagacgtcggcagaggtggaactgttggatgacaatgcagcttccatgcagcagtccagtgagaaggcggcagagacgctcaacaatctgcggaacatcaatatcgaggtggaacgcattatcggtgaagtgcaggagcagacgaaccggaccaacgattcggtacagaagatccatgaggcaaccgcgtttatcacgtcgattgcggaggagacgaaccttctcagcctgaacgcttcgatcgaggcggcgagagccggagagagcggcagaggattcggtgttgtggcagaccagatcaagaagctctccgagcagtcgaatgagtcgagcaaggagattgaggagactgcgaagacactcagcgaggattctgcaaaggcggttgagattatgcagcagatgcaggagatcattatgaaccagagtgcgagcatgcaggatacgcagaaggtagtggaagaggtaatcgcgcagatcggcagctccatgcagagtatccgtcagatcaaggagagcacaggacaccttgaaagctccagaaatgaagtgctgcaggcagtgagcgaactctcagagatcgcgcagggcaatgtggacagcacaaagaagacgtacgatgagacggaagaggtagtggataccttcaagcaggtgtatgtcagtgcagagcagctccgcgagatcgcagatgagctggtcagcagtattgattactttaagatgcagtaaaacgaggggctgcccgcttatggggcagcccctttttgacttgataagtaatattataaagagaagatcatatccttcgatttcagatggaatgcatctggaaattcggatcaaaaaatgcggcatttctaccccgtcggtttttgcatccgtgatgatccatgtttttccaagttttgagcactccacgggtgtgtccgcaacccgcagacaattttaggattctcgtgtgtcccttgcggcactgctgaatagaacataaccgcgcgaagccgctgtctgagtcgtcatctgccctgttttgaatagctgatgacgacgagttcggttcgcgcggttttatattgtctgtgaagcagtgccgctagggacgctagggaatccgttcattgtctgcggtttgtcggacacattccgtggattgtcaaaacgtggaagagacacggaatccgatgcaaaaatccgacaggaagaaatgtacgcatttttttcaacgaatgttccagctacatttccatctgaaatcgaagggcatgatctgttttccattatagtacttaccacgtaaaaagggactgaccgctttatgcggcagtcccttcttttatgattcttaggcggattgttcgcagcaattatgcctgcggaccagcagatacaagtgccttaccagcatcgttgccttcgtattttgcgaagttcttaacgaatcttgcagccagatccttagcctttgtctcccaatcggaagcatttgcgtaggtatcacgcggatcaaggattccagaatcaacacccggaagctctgtcggaacctcgaagttgaagtatggaatcgtcttggtcggagcagtcttgatggcgccgtttaagatggcatcgatgataccacgggtatccttaatggagatacgcttgcctgtgccgttccatcctgtgttaacaagatatgccttagcaccgctcttctccatcttcttaacaagctcctcagcgtacttggtcggatgcagctcaaggaatgcctgtccgaagcaagcggagaaagtaggagtcggctcagtgataccgcgctctgtaccagcaagctttgctgtgaatccagacaggaagtagtactgtgtctgctccggtgtcaggatagatactggcggaagtacgccgaatgcatctgcggacaggaagataacgttctttgctgccggtgcagaagagatcgggcgaacaatgttctgaatgtgatcgatcgggtaagatacacgggtgttctcggttacgctcttgtctgcgaaatcgatcttgccgtttgcatccagagtaacgttctcaagaagtgcgttacgtttgattgcattgtagatatccggctcggaatccttgtcaaggttgataaccttagcatagcatccaccctcgaagttgaatacaccgttgtcatcccagccgtgctcgtcatcaccgatcagaagacgcttcgggtctgtggaaagtgttgtcttacctgtaccggaaagaccgaagaagatagcggtattctcgccgtttaagtctgtgtttgcagagcagtgcatggaagccatacccttgagcggaaggaagtagttcatcatggagaacatacctttcttcatctctccgccgtaccaggtattaacgataacctgctctttgcttgtgatgttgaacataacagcagtctcggaattcagacctaactctttgtagttctcaacttttgccttggaagcgttgtatacaacgaaatccggctcaaagttctcaagctcctcagcggttggcttgatgaacatgttggttacaaagtgtgcctgccaagctacctcaacgatgaaacggatagccatacgggtatctttgtttgcaccgcagaatgcatcaactacgaaaagtctcttgttggagagctctttgatagcgatgtcctttactgcattccaggcttcctgggtagccgggtggttatcattcttatactcatcggaggtccaccatacagtgtccttggagttttcatctacaacgatgaatttgtcttttggagaacgacctgtatagataccggtcataacgttcactgcacccagctcgctgacctgtcctttttcgtagcctttcagctccggtttggtctcctcttcaaataacatctcataagaaggattgtacacaacttctgtggttccggtaataccgtacttgcttaaatcgattgttgccatcttattaaacctctttcctttcatatttatatggtaaacacctgcggatagcaggctttacgatatcttttccgggatgctggaatttgccaacttcccctaccataattatacatagttaactcataaaatcaataaaaaattgttaaaattttagcaaattctgtatagaaatgggagaggaaaagagggggaacctgcggcgggaggcgttgacagtacagaagggattcggtataatccaaaagagttcaaaacaggagtttatcggcagagatatgaagttccatggaaaagagaggccgcggcagacagccgtggcttttgcactataatatagaaagaagtgggttttaattatgaggtatcagatcagacacgcacgcgtccagttcggcggggacgtgattctgcgggacgtcaattttaaggtacacgacagggaaaaaattgcggttgtggggcgcaacggctgtggaaagacgaccctgctaaagctgattgccggggatatagagatgagcaacttagacagtgacgaggagtgcggcatcacgatggcgggaggccaggagatcggtttcctgcggcaggtcaactttgtggacgcggaggtgaccgtggaggacgaattaaaaaaagtttttgtaccggtgtttgcctgtgaggagcgcatgaaagagctggaggagcagatgaagacggcggcagagacaaaggagactgcgccggatggggcgctcctgcgcgagtatgacagattgcagaagcagatggaggcgatgcggggatattcctggcgcagggatatggagacgatgttccagcggtttggatttgcactggaggatctgcggcgtccgatcggcagtttttccggagggcagcagacgaaagtggcgtttataaagctgcttctgacgcgcccggatatcatgctgctcgacgagccgacgaaccatctggatctgccgacaatcgagtggctggaaaattatctgaaaggctatgacaaagcggtcgtgatcgtgtcgcatgaccggatgtttctggacaaggtggcggatgtgacctatgagatcgagtatcacgagatgaagcgctatccgggaaactacacgtatttcatgcagcgcaagcaggaggatctcatcaagcaggagaaggattacgaggaacagcagaaagagatcaaacggctgacggactggattgaaaagtggaagaacacaccgaccaaggtggcggcgacgcgctcaaaacgcatggcgatcgagcacatggtgaagattgagaagccgagacgctttgatacgcgcgcatttcacgggcggtatacgccgcgtatcgagagctacaccaatgtgattcaggcaaaagacctctccatcggctatgatgcaccgctggcagaggtgtcctttttgctgcagaaaaaggagcgtctggcgatcatcggggagaatggcaagggaaaatctacattattaaagacactgatcggagaactgccggcacttggcggcagcttcaaattcgggcagaacgtggagtgggggtattttgaccagcagaaagcggtgatggagcaggcaccgccccagcagaccgtgcttgagaatttctgggcagcgtatccggggtacctgcgcgaggaggtgcgcagcgcgctcggcggctttttattttccggggaggatgtggagaaaaaaatggggcagctctccggtggggagaaggtgcgtctcgcactgtgcaaaatgcttcagaccagaccgaatcttctgatcatggatgagccgacgaaccatatggacatcatcggaaaagaagcgttagagcagatgctgcgcgagtacgaggggacggtgctgttcgtgtcgcacgaccgctattttatcagcaggatcaccacgggcattctggaattttccggggacgccgtgaggcagtatgcgatgaattatgaggaatacctcgcagagaagcagaagtgtgcaggcggcgtggcagcgaatgcgggaagcgccgcagggcggaacgcgggaggcaccgcagaacggaacgcgggcagcaaaggaacaggcggcgtggcagcggaagcgggaaatgccgcaggacggaacatgggaagtgccgcaggacagggagcccatgtgagaggggcggcggataccggcagtgttccgacgctctcggatgtttttgacaagaagacctattacaatccgggcaaggtgcgctcccggctgcagcgccagaaggaaaagtatgagcggatgcttgcggagagcgaggagaagctggcggagcttcagatgcagatgttagatccggcgcttgcgagtgattatccgaagctgatggaactgcagagcgctgtggatgcggaggaagccaaccaggacagtctgctggagcggatgcttgagacggagacagaactggcggagtacgaagaaacataggagatgaatgcagtgtgtctgaatacaaagacagcagggagaaacgggttacgcttctttttccatccgctttaattccggcagcactgtagacaacattgttataaagcatagacttccaccgatgacgtttgataccggttctgcggcaaagacaccgtctgttcccatgccgaaagcataaggaagaagataggtcagcggcacgacgatgaacactttgcgcagcagggagaaaaagatggcgtgctttttcttattcagggatttgaagacggtctgtccgatgtactgcagatccatgaaaataaatgcggcaaagtaaagctttaatgagggaatggcgtcagcaaccagtgcggcatccgaactgaaaatgccgatcagcgcccgcggggcaaggatgatgctgctccacatgacggcggtatagagcagaatcaggagggcgagggtcaggatcgcttttcgcacgcggtccggccgtcttgcaccgtaattgtaacttaagatcggcgaggttccctcattgatcgcgtagatcggtgtttccaccatctgccggacgcttgagatgatggtcatgacggagatgtagacatcgccgccggttgcaccgaggacattgttgcagaaaatggataccagactgttcgtgagctgcatgataaatccggcggtgccgaggcttataatgttttttgcttcgaccagactggatttccactcagccgggcgcagcagccgcaccttatattccgcgcgccggtgtagaaagcggatcacatagagcgcggacagcgtctgggagagaacggtggcaagtgcggcaccggtgattcccagatgaaagacaaaaataaaaagcggatctaagagaaaattggtcacggcaccgatggcaaccgagagcatgccggcgacggagtacccctgcgcgttgataaaggggttcataccggtggcaatcatggacggcagcgtgccgagcagatagatcatcaggtaaggataggcgtatggcagggcggcatccgaggcgccgaacagcttaagaattggcgctgcaaacagcaggccggctgccatcagcaccagagcgccggcgcacagcatggtaaatgaggtattcatgatctgaccggcttttttggtatctccgccgccgcggctgattgagaaaagcggggcgccgccgctgccgaaaagattgctgaaggcggtgatgatgacaatgattggaaaacagagtccgacggcgccgagcgctgtggtgccgacatccgggatgcgggcaatatagatccggtctacaatattgtagagcaggcttaagagctgtgcgaccagcatgggaagggcggctcctaaaatatttccggtgatggttccatgttcaaaatcgattcgtttcatatgataaacttcctttatgtatctgcgcggatttgttgttgctttacgctgcaatccagtataccatgatttagaacagatgaaaaatattgtttggatgagaactgatcagacgggaagagagtggaaacggaggatgggacggggaccggaaaagttaccgtgtacccggtgttttccggaattgaactatactacaatgacatgcacatggcgtactgcaacaaggagcagaagactgtgtatgggactgccctgttttcttactaataaaaatagaaaaacagggcagttttttgtggagggaaaggagagagagatggatgtggagataaaaaagtgaatgcgattgtggctcgcatggaagaaaggataacagacacaagtttaattgtggaaaacaggaacacctgtgatgacaattctccgacggtaccgctgacggagaagcagattgcagaattacgtgcgtgtgcagcaaagtaggttctgatgtgtccaggagtgcgttctttctttttgcgtaggagtgtgctatactcggtgacaaatgaggtttgatgagaggcttgctgcgcaaaagcgggagaggagcaacatgttatattaccgggagatcagtttaaaagatcaaagaaaatgtcttttgaaaaatgcggaacgggcggatgcagcggcgtttctgcactattttacacaggcacacgcggagacggattttctgacaacgtatgcggacgaagggacgcactcggtggaggacatggaagaacggcttgccgcgcaaaaggcgagccgcacggagattgagatctgtgcatttgtggacggcatcctcgtgggatcggcgggaaaccatgcgcttagtacgcgcgagaagctaaggcaccgcgcggatttcggcatcagtatcctgcgggaatactggggacagggaatcggcgcggcgctgaccggcgcctgcattgactgcgcgaaagaagccggattccggcagctggaacttgaggtggtcggtgacaatgagaacgcagtgagactgtataagaagtacgggtttgtggaatacggaagaaatccgcggggatttctgacccgcgacggcagatggcaggaactcgtgctgatgcggttggagctggaagatgcgggtgcgcgggaaaatgatgcggggaatggagagagcgatgttttttaaggaagatacgacgtttaatgatattcgggataaatcgctgcagcagtggctggatgagatggagcagcatgaggacgtggcggtccggggcggtgtgaagctgacaagagagtatgtgcagtatctgaaggatgagatcggaagactccggcatgagaatgaagtgaagaatgcatatctgaaaaagctgcgggagaagaggtaggaggtacagaacgtgccagagaatacaagtatcattttctttgatgaatataaaaagctggataaactttgttcggaaatgtacggtataaacagcggcggcgtaacatgttatctgaatgatatgatggctgttccggtcatgcaaagaaacaggattccagaatggaatcagacatatgacaggcttagagaactaagacatataaggaatcagatggcacacggggaaggctcgtttgaggattatccctgcagtgaagaagatgttttatggcttttcgagttcaggagtaagatcatgcatatctcggatccattggctgtatatcgaagccagacagaggaaagtatgcatgcaacccgcataaaagaagatttcccgcgggctgtagatcaaagccagacagaggaaagtatgcatgcaacccgcgcaaaagaagattttctgctggctgtagatcaaagccagacggagggaaatattgcagatcatcaaagaatgaaaatggataatgtggaagtgatcgaccaggaagaaaacgactcttttgagaaaaaacacagcatgttaaagaaaattgccgttttcggactgattgtgctgatcgttgcagctgccgtgttgatctttggcaatgtttatatgaaatattttctgctttcataattagcggagtgaggaaatgataagcaggtatcaggagaaagagggttaaaacaatgaaatatcagtcggttgccattcttggcgcaggagcagtgggttcttatgtcatgtgggggcttgcaaaaaagaaagagattgatctgtgcgtagtcgcatcgggagagcggaaggcgcgctatgagagggacggctttgtcattaacgggcaggtataccaccccgctgttaggacgccggaggaggctgccggtgtcgatcttttaatcgttgcaaccaagtatcaggcacttcgcccggcacttggcgatattcagactgtggcaggcggacacacgacagtgatgagcctgatgaacggcgtggacagcgaggagatcatcggagaggtcattgatccgtcccaaattgtctattcattgatcaaggttgcctcggagcgaaagggcaatcaggtggtattcgatccggagacgaccatcggtattgtatatggagaggcggatcttagcagaggcaccggacgcattgaggcgctgaacgatcttttcgcgggtacagggctgcactaccgtgcgacggacgtcatccgcacggagatctggagcaaattccggctcaacgtaccgaacaaccaggcacaggcgatggtggggtgcggggtaggcgcctaccgtgacagtgagcatgtggcatttttgcgggaccggctgcgggaagaggtggaccggatcgcggagaaaaaggggatcgattttgacaaggcggatacctcgtccaccttcggcagtaaggtgcgggatcgggcgcgctattccacactgcaggatctggatgcggggcgccacacggaagtggacatgttcgccggcgcggtggtgcgcatggggcgtgaactggggatcccgacaccgtacaatgagtttacctaccatatgataaaggcactggaggagaaaaacgacgggaagttcgattatgagtaggggatggggaaaataggataagaagaatgacgggaagtccgatgggaaatgatcggatttctcgttttttattttataggaaaatgcgccctatgaagtaaaaggctccgcggggatcgcactgtggcgatgacaaaggatgtcgcaagaggcaggagcaatccgccgcagggaaggaatcctaaaagaggatatgccttttgtctggtaatgggagagacgatgcaggggatattttagggcatcggtagaaagggggagattcttgggactttttgcaggatgccgacggaatatgataattttcgacaaatgcggtatgacaaagttttttattattaggaaagagaaggtggcgtatatggataaaatggataaggcgatggagggcgttttggaatatttgaaacataagggaaaacttacggaactggagaatgatattcttcttgcaacgcaaatctgtcaatcaagcccattcgatagcgaggcggctaagaaaagaataatggagtttaatgcaaaatatagggaagtatgcagttctattcttgtaactccgggaatcaaaacaaaaccattgtttgacatgaaagatgaggaagtctgggaaagcctctggatacaagtggaagcattgtgtggaagggaactgggggagattgagaggagaaggatgagcagaaaattgaagatgatatgatgcattatacttgtaaatagaacgacgattgaggtagaatggaagagaagaggaaaagagttataaaagatcgattataaattatgaagaaaattttcgtattggtggaaaaatgtaagcattaaaatatgcaagcatagaacttgatgtgtgatttggtaatagggtcaatggatgaaatagtggaaagggatgtgagtttatggaaaatgtggaaattaatattactcctatgtctttgaaaaatggtgttatgggtttgcctatacaatgttgtagaaattgggatgcatcagggagtgttgaaggtatttttcagtatgcgggacgtaaatcttctataacattttcgcctaagcataaaaataaagaaagaggaacagctgcagcgtggcaatttactgttaatgattcgattcagtttaatcagttaaggatggatggaattcatacatatgttgaggagatttctattggagaaaagctgatatgctcattatgcgaaagtggtggtttgtatttccttacagttgaaaatgtgatcaatagaccggaaactaaggcaacacaaaaactgaaagctttattgaaacaaggatttcgggaagaaaccggaaaaatgtcaaaagcgccagtgtggaatagtccaagtgaatggatttcatttgataaaatcagcaattattctgaagtgcaagattgtctttatatttggacaggaaagaagacaggatataatacggtatatttatatgtcggaattgtgggtgatacaaaaagcgaaggccgtagtaagcgaaatttgatgcaaaggctgaaagaagaacagaagaagttctatacggaatgtggtgttaatattgagcaatttagatattgttcgcttaataatgcctttgattattctgtaccagaattactaaaaacggttgaaatgtcacaaataacggttatgacctctttgtttcaatgtaaaaatgcaagagataatatagacgcattgctggcggggtatgatgtaattcttttgaataaaatgacatcatataaatatattaagtaaaaattgcagatatgaaatttgataattatgaaatcttctcattatggttccgttcataccgcccggagggcgttacgactagctttttggatgataattgatgatgatatttcgttaaagaatccatttggatgtcagtttgctggagtattggttaatgatgtagtcataagagaggcaatctccaaagactaaatgagaaaatttctaaatatctgaattttacaaattgacacagaaaggcgttgatcttgaaaagcaaaacatgaatatcgactactagttgtagaaaatatagtatatgcgatatgctgataaactatagtgatataatggtgttgtagtttgatacggatgtggcacaactgtttcaaacaatcatcatgaataggaacgcgactaaagtggagaaatctatagacggatatagtggatttcctttctgtgataatgtaatgccaattgtggccctgtactgatagcaccgattcaacagacagcaataatatttatgaaatgtctaagagtactgttatttattgaaagtagaaaagaatttcagtggaataagaatagcagagaagggatttaatgaactttaatgaagaacataagctttgaagaatgagtggagatttgtatggtatttgttccacgtatggaatataatgtatgtaggagggggtaatatgaataagacatattcaatgagtatacgtgttagtgaggaagaacttgaaaagcttaaacaagctgctcggttagaaacctacgcttcgtatagcgagtttgttagaagaactgccttgctagaggcatcaaagattattactgagaatactgagaaggagaataagaacaatggctaaaaaagattctagcgaggaaacaaccaaaggtttggttgcagataaactgaaagaaattgatggctatcctatggcgcaaaatacaacagtggatgggataacttggttcaaagaagatagctataagggaacgtcttatgattggctgaaagatgtatttaaaaaagcatcaaagaagcagactatgcgttcaaagggaacgccagattatgttgtaacacttgatggttcagacatcattatagttattgaatgtaagggctctgtagatgatcattcatgtctagatgacgttgaagattatgttaaacatgggtatggtggggcagatgaaactgaaaagtatgcaataaacggagcgttatggtatgcatcttttttgaaatccgattatgatgttatatctattggcatttcaggtcaaacggagcaaacagcaagagtttcgtcttttgtttggcctaaaggtgaggagatttcgagtattgcacttattgaagatggttatttggataattcgctagtatctattacccagtataagtctgatgttaacagtgttcttggaagaatgggagaaacagaggaaactgttagaaagcagttaagaaggtatacgcttaattgtgctaacttcttaaggcagaatggcattgaagataattcaaaagcaggatttgtgtcagcaatcattcttggcttaactaatcatgaatctgcattatataaaaacacaaaaaatgcaattgaccataagaagagtactaaagcgaagaaaatgctttctgatccgattggaaaaagtgctgttaatcagcttaaaagctcattgtatggcgatggcaaagatatatatgatgaatcatatataagaggaatttgggatatagatggaattccgcagggaaaaagaatatctctaaaaaagttttatgatacgcttcttgcaaaggatgagttgacacaggcaccaaagggaaaagataaattatttccagacggagatactgtcttgtcatgctgcatatattctttgtatgaaaacgtaattgaagtactagatacttatactggtattgatgtaatgggtgaattttatactactttcttaagatttacaaaaggcaatgcaaaggaaaagggaattgtattaacgcccaagcatgtgacagaacttttttgcgatattgcggagttttatagtgacagaaaatttgatgagaatacaaagatattagatatttgttgtggaacaggagcatttttgattgcttctcttaacaggataaaacaaaatattcaaagtgaagtagttagcgatgaaaagaaggtatctagatatgaggatgcacagaagaacagcttaataggagttgaacgtgatgcatctatgtatgcacttgcttatgctaacatgagatttcacggggatggcaaatcaaatttatttaactgttcttcactgttgatagattcttacgctccggtagatgatagcggaaagacatatacagatacaggtaaaattcctttaaatgaagcgttaagtgattttggtgatatagatattggtatgattaatccaccatattcacttgataaaaaggataattcttccaagcaagaatatcctatagttaagcagataaatgagctaaaagataagaataaaaggcttaataaaaaaatcaaggaatatcgaaaaaagacagacggaaaagattattcagaagctatttttaattgccaaaatgagataaaagccaataatgatttattaaataagtatgaaaaagattttacaaatagtggattaagagaagttgcaattcaaaaggggcaagatgagttagatttcattgcttccatgcttcattatttgaaaaagggaggtattggtttggctattgttcctatgtcttgtgcgggaaatagtggtactaaattaagagcagagttattgaagtatcatacattacttgcatgtatgacaatgccaccgcaattattctatgatagccatgtaggaacagctacttgcattatggtatttaaagcgcacattccacatgataaaaacaaagcaacatttttcggaagatggcaaaatgatggattcaaggttattccacacaacggaagaaaagacaccggtgcatggagtagtatacgagaagaatggataaaccaacttgatggtaccgcagccattgatgatacaatttggcttcgtaaaaagattaacccgaatgatgaagcgttggcagaagcatatattgaaactgattataataagttggatgattcggtatttgaaaggacaatcaagaaatatgcattgtataagtacatggatgaaaagggtttgttgggggattaagtatgaaacggctcgatgaaatattcactgttacatatggtgttaatctggaattatgctatcttactattgatgattcagaagatgcgataaactatgtgtcgcgaacaaagagtaaaaatggtgtatccgctcgtgtttcacgaatggagaatgtgaaacctaatccaggcaaaacaatttctgtagctttgacgggtagtgtgttagaagcgttttatcaggaagaagaatactattctggaagagatatagcatatctaacacctattaaagatatggatatgtggactatgattcagtattgtaccattattcgatataatcaatataagtattcatatggacgtggtgcaaacagaacaattggaaaattatttattccagatcttgatgaaataaaaactttcccgaagtataatcaacttccggatatatcacagataccagattactttttgaacgagggatataataaagcgtgttggtatttagataacattgataaagatgagtttgaaaagaaatatgctaaacctgcaattaataaaagaatatcactaaatgacagaaaatgggattatttcaagttaaacaaattgtttgatataaagaaagggaaacgattaacaaaagctgatcaaacaatgggagatactccctttataggtgctacagcaattaataatggggtaactggttatataggtcaagaaccaatgcatgaaggtaatactatttcattgacgtataacggttcgattggtgaagctttttatcaagaagtacctttttgggcgtctgatgatgtaaatgttttatatttaaaaggtagggaattaaatcctcatttagcattatttttttgtcaaattcttagattggaaggcgaattacattcttacgccagaaaatggaatttggaacatatgaatgatacaaagattaagcttccgattgataaagatggggagccagattatgactttatggagcaatatataaagtcattatcttttagtggaaatatcggataatcaaataataatatagttaaggagcattttagagtttgaaaaaagtctaaggtgcttttttatccacaaaaaaacgaagggagtaagacaaagatttaaaacacagaaaatcaaagtaactattaaaaactgagtaggcattagctagggcaaaggaaaagcttagcaaatgtgaaccatcagtttgaaacagcgaaagcggaggtaaataagtcattcccacaaggggcggagttatccggaaaaatggagagtctgacagaatgaatgctttacttagcattaatgaaaagtaggagtatgattggaatggatgacgaagcagaactggaaagaaaacttgtagattgatcatcagaacggattccatagaaggggaaagataatgatttctgaggatgctgagtttgattattgttttactgtttaggtgggaggcgttaatcaatcaacgagaatttgaaaaatttcctaatcatacgacagctttgtggctagtaaaaacataaaacttttaaaatggtgaaatcttccttggtatggtataatatatttattgcgctagggctgctttgaagaaagggaaaaaggcatttgagcgaaagaaggcgtaagcagaacagacgtgataaaaagaggggtattttatgaaatagagaaagccagcgagtagatggtagatacgcatttatcagacagttttggaaaacagaagatttttaaagtcatattgtagaaaaccgaaaagctaaagaagggaccggcgatagatggatataagggattttggtatttagacaagaagaatatcccggaagttgctttacattgggaaaagtactttgagcggacaagggctaaacataatggaattttaaaagaatagttactaaaaccacaccacatgtttgtggcatacttgttgcagtaatagcgggataaaccataaaacactttagtattttattggacattctgccattggagtaataatgaatacatatatgcatctgggagcagaagatgctaagaaagaatttggcaaatatacgaagatggcttaaataattagaaaattgcgacaaaaaagataacctaagtgaaaaaagtctttagtaaaatgagaagatcgatctgttttactaagatttttactaaatctggataacagaatatgcggatttatgtcacgatatgcgacgaaagtaaagaaaataatctatcgtaaaagtgaaataaaatcagtattttcaaggagtttttaaggcatgataaaaatattatttatttgccacggcaacatctgccgttccccaatggcagagttcattttaaaagacaaagtcgaaaagcgaggtctcacttcccgtttcgagatcgcttccgctgccacctccacagaagagatctggaacggaaaaggcaatccgatctatccgccggcgcaggcagaattgagacggcgtgggattgacgggacggcgtacacggattttagcggcaagcgcgccaggcaggtgaccagggaagactatgagcattatgactatttactctgtgcagatactgcgaatatccgcaatacgatccggatcacgggagcggatacggaggggaagatcaggctgttgttagattacacggacagaccgggctgctcaatcgcagacccttggtacagcggtaattttgaggatacctaccgggacgtggatgccggatgcgagggatttctcgcgtacttaaaagaaaaaggtgcaatttagagaagatgtcagtaatgcaccgtgccgcacatattttacaaaatatttgaaaaaatatcttgaaaaccccagaatgatgtggtataaatgttacaacattaaattgttaaagcatgaaaggctatgaaggagactcttatcttcagacatcgacaggaatacagcgtcaccgactgagagcgctgtttgagagagaagataacgggaacactctggagcagactggttgaacaggcggttatcctgcgggtagaagtaagagtgggacggcagcggtaaagtaggtcagtacgttggtgcgcgttaagcacaaagagtggaagaatgatttttgtgaatcatttttcaaagcgggtggtaccgcgggaatacaagcagaagttgcagaagaagatcccgccccggaaagacagtttgtctttccggggcttttttgttctatttaggaaatattgcatcaggttaaatgagaaagcagccgatgcacgaaaggaatcccgtcccgcacctagatcaatccggcagcaccggacgaaaaggagcgtacaatatggaatatgtaacaggagtgagcaaaaaagaaacggtggaaatcagtgaaatcctttccggggatttcgagggaaaacaggtaaaagtgaatggcgccgtccacaccatccgcgatatgggcgaggttgcatttgtgatcctgcgcaagagagagggattactgcagtgcgtatttgaagagggaaaaacaaagttcgatttaaaagaactgaaggaagcgtcgaccatcgaggtggagggaaccgtgcgggcagagcaccgcgcgccgaacggatttgaggtacgtctggatacaatccgcgtgttgtcggaaccggcggaacagcttccgtttgcgatttccaagtggaaactgcaaacgacgttggagacgaatctggatcaccgtgcgattgcgttgcgcaacgtcagagagcgggcgaagttccgcatccaggagggcgtggtcagaggattccgtgattttctgtacagcgaagggtttacggagattcatacaccgaagatcggagcgaaaagcgccgagggcggcgcgaatctgttccggctggagtattttcacagaccggcagtgctgcagcagagcccgcagttttacaagcagatgatggtgggcgtgttcgaccgggtatttgagaccgcgccggtgttccgtgcggaaaagcacaataccaagcgtcatttgaacgaatataccagccttgactttgagatgggatacatcgacggatttgaggacatcatggcgatggaaaccggatttttacaatataccatgaagtttttggagcgggattacgccaaggaattaaagatgcttggcgtgacgcttccgaatgtggagcagatcccagcggttcgctttgatgaggcgaaacagaaagtggcggaaaaatatcaccgccagatcagaaatccttacgatcttgagccggaagaggaagcgctgatcggacagtattataaggaagaatgtggtgcggattttgtatttgtgacacattacccgtcgaaaaaacgtccgttttatgcgatggacgatcccgcagatccgacatacacgctgagctttgacctgttgtatcacggactggagatcacgacaggtggtcagagaatccacgattatcagatgttgctggataagatcgagaagcgcggcatgacgaccgagggaatggaacagtatctggcggtattcaaatacggcatgccaccgcacggcggactgggaatcggacttgagcgcctgaccatgaagctggtcggcgaggacaatgtccgcgagacaaccctgttcccaagggatttaagccgcctggaaccgtaaacaagacccaagagaacaaagcggcttaaatcgcttttggatctaagccggttagaaccgtagaaaaataaaaagcaacaaagcggcttaaatcccttttagattctaagccgcctggaactgtagaaaaatgcaaagagaacaaaacggcttaaaataacaacagaaaaggaactcacacatgaacatagaacaacagattgcagactacaagccgtacaatgagcaggaagcacacgatcaggcagtgatgcggcagcttcttgccacacagccggatttatttacaagagagaatcaggtggcgcatatgacagcgtcatcgtggctgttgaacgccacgcacgataaggtgctgatgatctatcataacatttatcactcgtgggcgtggacgggcggtcatgcggacggagacagagaccttctggcggttgcgaagcgcgaggcgatggaggagaccggcgtgacagagatacgggcgatttcggaagacatcttttcacttgagattctgacggtcgacgggcatgagaagcgtggagcctacgtgccgtcgcatctgcatctgaatgtgtcgtatcttctggaggcggatgaagccgaagtgcttcgcatcaagccggacgagaacagcggtgtgcggtggtttttcctggaggaggcgctcgcggcgtgcagtgaaccgtggatgattgagagagtatacaaaaagctgaatgcaaaagtgcgggagcgtttcggcgggacgtacgggatgcagagaggagaatgacagtgaaagatttgggaacaaaacggcttgagacagagcggctgattttgagacgttttacattagaagatgcagaaaaaatgtatgagaactgggcgggcgatcctgaggtcacaaagtttctgacctggccgacacacgagagcgcagagatcagcagacagatattaaaagagtgggtagcggcctatgacaatccggaggtataccagtggtgtatcgaggaaaaggagagcggagagccggtcggcagtatcgctgtcgtgagccgcaatgaaaaggcacagtcctgcgagatcggttattgcatcagcaggagccgctggcacaaaggcattaccacggaggcacttgccgaggtcatgcgctatctgtttgaggaggtcggcgtactgcggctggagtccagacatgatccgaagaatccatattccggagaggtcatgaaaaaatgcggcatgcactacgagggtactagaattcgtgcagactggaacaataccggtatctgtgactgcgcattgtacggcatggtgacatacgtgggtgtcgggaatgcggcacagacgacagatagcgtgcagttgaatggaactgcaggatgggcagcggacggtgcagaggcgaaaggggagaagcagggagcgcagacagagcgcacaccgaagaacgtgatttccgatgagacgatcgagtacgtcggaatccttgcgaagctggagcttgacgacgaggaaaaagagcgggcgaagaaagatatgggggagatgctcgattacattgacaaactcaatgaactggacacggagggcgtggaaccgatgtcgcatgtattcccggtgaataatgtattccgggaggatgtggtgacaaatggcgacggaagtgcagacacacttgcgaacgctccggtgaaaaaagacggcggctttaaggttccgaagacgatctcataaggcagggcatgagagagcgtgcatgcgcatgaaagagggaaagtgaggaaaacagatgagtttgatgagtttgactgccgtggaactcggcagaaagataaaagaaaaagaagtgaccgtcgaggaggcagtgacggcggctttagatgcgattgagaagcgtgaggcacaggtgcacagctttgtgacggtcgacagagagggcgcattaaagcgtgccaaggaagtgcaggcgaagattaatgcgggagaactgaccggaccgcttgcgggtgtgccggtagcgatcaaggacaacatgtgcacgaagggattgcttacgacctgttcttccaaaattttatacaatttcgtcccgacctacacagcggaggcggtccttaatctggaaaaggcaggagcggtcatcctcggcaagacgaacatggatgagtttgctatgggaagcacgaccgagacctcggcgtacggcgtgacaaaaaatccgtggaacaccgggcatgtgccgggtggttcgtcgggcggttcctgcgcggcggttgcagcggaagagtgcagctatgcgctcggttccgacaccggtggctcgatccgtcagccgagctccttctgcggcgtgaccggcatcaagccgacttacggaacggtatcccggtacggactgattgcctacggttcctccctggatcagatcggaccgatcgccaaggatgtgaccgactgcgcgacgatcttagaggcgatcgcatcacatgacgtcaaagattccacatcggtgcagcgcgaggactatgattttacaacggcgcttgtggatgatgtgcgtgggatgaagatcggtatcccgagagactatttcggcgacggactggacccggaggtaaaggcggcggttcttggcgcggcaaagaagctggaggagaaaggtgcgatcgtggaggagtttgatttaagtctggtcgagtatgcaatcccggcttactatgtcatcgcctgcgcggaggcgagctccaacctggcacgttttgacggtgtcaaatacggttatcgcacagagcagtatgacgggcttcacaatatgtacaaaaagacccgctccgaaggattcggcgcggaagcgaagcgacgtatcatgctgggatctttcgtgctgagcagcggttactatgatgcctactatttaaaggcactccgcacgaaggcgctgatcaagcaggcgtttgacaaggcatttgaaaaatatgacgtgatcttaggaccggcggcaccgacgacggcaccgaagcttggcgagtccttgagcgatccgctgaaaatgtatctgggcgacatctatacgatttccgtgaaccttgcgggactcccgggaattacgcttccctgcggaacggatcagagcggactcccgatcggtttgcagctcatcggtgattgctttgcggagaaaaaaatcatccgcgcggcatacgcttatgagcagaccagaagctacgaacacagtccgttggcacgatgacagtgggaggatgagatagatgagcaaaacatacgaaaccgtaatcggactggaagtccatgtagaattagcgacaaagacaaaaattttctgcggctgctcgacagcctttggcggagcgcccaacagccacacctgcccggtgtgcaccggtatgccgggatcccttccggtattgaacaagcaggtggtggaatatgcgatggcggtcggacttgcgacgaactgcacaatcacccagtattgcaaatttgaccgcaagaactatttttacccggataacccgcagaactatcagatttcccaactgtatctgccgatctgccgcagcggcggcgtggagatcgagacggctgccggcaaaaagacgatcggtatccacgagatccatatggaggaagatgcgggaaaactggtgcatgacgagtgggaggacgtgtccatcgtggattacaaccgttccggcgttccgctgatcgagatcgtgtcggaaccggatatgcgctccgcggaggaggtcattgcctatctggaaaaattgaggctgatcatccagtatctcggtgcatcggactgcaaattaaacgaaggttccatgcgtgccgacgtcaacctgtccgtcagggaggcgggagccgctgagtttggaacacgtaccgagatgaaaaacctgaactctttcaaggcgatcgcgagagccatcgaaggcgagcgcgcccgccagatcgaattgatcgaggaggggaaaaaggtcatccaggagacccgccgctgggatgacaacaaggaatcctcccacgcgatgcgatccaaggaggacgcacaggactaccgttatttcccggagccggatctggttccggtggtcatcagcgacgagtggattgagcgcgtgaaggcacgccagccggagatgcgggatgagaagctgatccgctatcaggatgagttcggtctgccaaaatacgatgcggagatcctgaccggagacaaatcatttgcagatctgtttgaggcagcggccgcgatctgcggaaagccgaaaaaagtctccaactggatcatgacggagacaatccgcctgttaaaagaaaatgaaatggatccggatcagatccgcttttcaccggaacatcttgcaaagctggtggatcttgcggatgccggttccgtcaccaacaccgtggcaaaggaagtcttcgagaaagtctttaaagaggacattgatccggaagcctatgtgaaggaaaaggggcttttgacagtcaatgacgagggagcactccgtgagacggtggcgaaagtcattgcggagaatccgcagtcggtggaggattaccacaatggaaaagaaaaagcgatcggctttctggtcggacagacgatgaaagcgatgaagggaaaggcaaatcctgcactggtgaaccagatcttaaaagaattgctgtaagcggtcagtgtcttttgtagtgataagcagtattacaggaagaactgagaacagaaagttccggaataaccatacggcggcaaattttttgaagcaaaattcaagtatttcttccatgccgcggctggtatttcattccgtgtctcttccacgtttggactctcccggagggtgtccgacaaatcagagacaatgagcggactttctagcggcgctaatgcgcgctccctcataaacattataaaatcgcgcggactgaaactcggagacttctgctattaaaaacatggcagaaatctcctcagacatcagtccgcgcgattaggttttactcggaagcgtgcaaagcgccgcacgaaagctcctaaaattgtctcatgatttgcggacaccgtccgaggagtgctccaaacttggaaagacacggatcatcatgaatgccagccttcgcttggttagaaataccggattttgcggtcaaaatttgccgccgtatggttatctggaactttcaggtatctgtttctaataatactgcttatcccttaaaaaggcacagtcggtttatctgcggttgggattccggtatttttcttcgcagtatttgcagcggtagacttccttttcttcatcggtcaggaggaagatctggtcaagctcctgctcgatggaagtgatacagcgcggattcctgcaggtgatgacgttcttgacctgctttggaaggtgcagttcctttttctcatagatcttgtcgtccttgatgacgttgactgtgatattgtgatcgatgaagccgaggatgtcgagatccaacgcttcgaccgggcattccaccttcaagatatccttcttgcccattttgctgctcttcgcgtttttgatgatggcaaccgtgcagtcgagctcgtcgagcttcaggtcgtggtagatctgcaggctcataccggctttgatatggtctaatacaaaaccctcgtggattccactgatatttaacatgtatctgtcctttctgccgattttatttaatcgaccctgatgtctaagagtgttaggatcagcgccatgcggacatagacgccgtactgtgcctgcttgaagtaggcggctctcgggtcgtcgtcgacctcgacggagatctcgttgactctcggaagcggatgaagcaccagcatatcctccttggcgagatccatcttcgctttggtcagaatgtagaaattctttaagcggacgtagtcttcctcgttgaagaagcgttccttctgtacacgggtcatgtataaaacatccagatccggcatggcgtcttccagacgctccacttcggtaaatgggatattgttcgctgcaaggacgtcctcgcggatgtagcttggaattctaagttcttccggggagatcagcacgaaacggatgcccggatagcggatcagcgcagagattaaagaatgtacggtgcgtccgaattttaagtcgccgcagagtccgatcgtgagattgccaaggcgtccttttaaagaacggatggttaacagatcggtaagagtctgggtgggatgctgatgaccgccgtcgccggcattgataacgggaattcgggatttctgggaggcaacaagaggtgcaccttcctttggatgacgcatagcacagatatctgcatagcaggaaataatacgaatggtatcggaaacgctttcacctttggctgccgagctggaatcggcactggcgaaacctaaaacagaaccgccgagatttaacatggcagcttcaaaacttaatctggtacgggtgcttggctcataaaaacaggttgccagctttttcccttcgcatgcatgggcatacttctgtgggtacttctcgatatcgttggcaagatccaaaagcttgtccaactcatcgacggagaagtccaatgggctcattaaatgacgcataaaatcctccttgtattgaccggaaacggcagaacaaatctgtctgtctccaggcattttttctatcatataataatcattctgtgaattcaaggggaaaaatatttacgcacgaatcgggaaaagacgggctgtttggcatgatatttcaaaagatggaagccgttttctgatatttggttgcgcgaaaaagaaaaatgaagtaaactacaggtacgcagaaaagaatgcaaaaagtttcgcctggggaggaacatacaaggaaaggaagaacagacatggcagaagagacaaattttagtcagggagaagcggaggaggtaaagtatcaggagcgtaaacggttacttttcttcggacttccatggacatttaccaaatatacgatcagtcaggatatgattaccgtcgatgagggattgatcaaggtggaagagaatgactgctacatgtacaaagtgcaggatgtcaagctgacagccacactgccggagcggattttcgggctgggaacgatcatctgctacaccggagacgtgacagacaaggaacttcgcctgagtcatatcaagcatgcaaaggagattaagaattatcttctgaaggcatccgaggcggcgcgcatcaagagacgcacattaaacatgcaggacatcggtgcaggcattgcagatgatgtggatctgtaggaagtgtgcggcatcgccgcgcgctgacgggttaagtgagacggtcggtgtgcacgaggatgcgctcgaagagcagacctgcgccaagccacaacggggcataatccagccggatcagcccgttgacgtttgccctggcgctgctgtagtcccaggggcagaagtgatgccgccttaagagtgatccggttaagtactcgaatgaaaaaatacccactgtatagatgctgccgcgcaggagtgccggcagcttttttatttttgcgtagaccggaccgatgcaggcagccataccgtagatggggaacatccacagggaggtctgaccgatcagacggccgtcgtgtcttgcgagggagcctgcggaggtgaacagaatttccatgcaccagccggtcagtccgcagatgagaaaattacgtccgcgcatatgagagattcctccggttttcgtttatttcagtatttccggttcctgacaaaatatgtacattttctgaaattaaaatgaaataaatcgggataacttgtaaaaccttaagatctggcatataataaaaaaagcgaattcggcagaggatgacatgcggctgaatcaattattgaaacatcttacatatgaacatgtgcagggaagccagagccgtgagataacagacatctgttaccattccgggaatgtcagggagggctccctatttgtttgcctaaaagggctgcatgccgacgggcatgactatctgcagggagcgctggaagccggggcggcagcagttgtgattgcggcggagaatgtggttccgctggacaatgatgcgcttttgtacacggaacagtttggtgtgcggatctcggagattatagaccgatggaaggtttccatcgtgatcgcggcggataccaggcatgcgctcgcagaacttgcggcagctttttttgattatccggcggcaaagcttcggatggtcggaatcacgggaacgaaagggaagacaacgacggcatatctgctttctgcgattcttcgtgagagcggacacaagaccggaatgatcggaacgatcgcgatcgataccggagatggcgtgcttccggcagtacatacgacgccggaagcctacgagatacagaagtatcttgcacagatggtggacaacggctgtgatacctgcgtgatggaggtctcctcccaggggttgaagatgcagcgggtggaggggatattttttgacatcggcatgttcttaaacatcgagccggatcacatcggggagggcgaacatgcgtcgtttgcggaatatctgttctgcaagagccgcctgatgcgccagtgccggatcgggattgtcaatcgggatgatccgcacacggagcgtatactgcagggacatacctgcagcgtggagacgttttccctgtggcatccggcggatgtgacggcggagaatatccgctttttcatgcagtcgggagaacttttgggaagctttctggtgcgtgtggagacggcggtgtatccggtgagaatgcagctccccggaatgtttaacgtctacaatgcgctggcggccataggggcggcaggacatctgggagccacggagagcgacgtcggtcttgcgctccgcagtgcaaaagtccccggaagatgcgagaacgtgaggcagtccgaaaattatgccattctgattgactatgcacacaatgagatgagcttaaaaaatcttctggaaatgctgcgcggttttaagccgcggcgtcttatcgtactgttcgggtgcggcggcaaccggtcgaagctcaggcggtcgaagatgggagagacggcgggacatctggcggatcttacgatactgacttccgacaacccgcgctgggaagacccggaggagattctggacgacattgaggacgggatccggggaactggcggacagtatgtgcgcattgcggaccggagggaagccgtgcggtatgccatggcgcaagccatggagaatgacatgcttgtgcttgcgggaaaagggcacgaggcatatcaggagattcgcggcgtgcgctatccgctcagtgaatacgagctggtggaggaagcgagacgaagccctgacatgggggagaatacagacagaaacgaggtggacagatggcggaatatgcgaaggtgattgtggatatttcacaggaaaaactggataagacatttgagtaccgtattccgccgtatctcacacagcggatcacagtcggaatgcaggtctatattccgtttggcagccgcaggatcaccggctatgtggtcgagctttccgatgaggcggagtatgacgaggataagctgaaaaatattgcggggatcgtgacggacagtgtgccgatcgagtcccatctgatcgcgcttgcgggctggatgcgggaacattacggcggcacgatgaaccaggcgctaaagatggtacttccgatcaaggagaagaaaaaagctgtggaacataaaagggtgcggcttgcgcttcatccggtagaagcgaagaaccagctgggagcgtatgagagacgccacagcaccgcccgcgccaggctgcttcgtgcgctgctggaagaggaggagctggactgggatcttgtcacacacaagcttggggtgtcgggaagcgtgatccgggcgatggaggaatccggcgtcgtcaaagtaattcgggaaacgcagtaccgcaatccggtgtcccacctgaccagcagaggatatgggctcactttaaacgatgagcagcaggaagcggtggatgcggtctggtcggattacgagaagggaatccggtcgacctatctgataaaaggcgtgacgggcagcggcaagaccgaagtctatatggaactgatcgcaaagatgcagaaggcggggcggcaggccatcgtcctgattccggagatcgcactgacctatcagacggtgctgcggttctataaccggtttggcgaccgggtatccatactgaattccagaatgtcaccgggggagcgctacgatcagttccttagggcaaaaaacggggagatcgacgtgatgatcggtccgaggtcagcactgtttacgccgtttgccaatctggggcttatcatcattgacgaggagcatgagacttcctataagagtgagacggttccgcgctaccatgcgagggagaccgccatcgcgcgggctgccatgcttgacgcgagcgttgtgctgggatcggcaacgccgtcggtggacagctattaccgggcgaagcgcggggaataccggctgcttacgctcacaaagcgcgtgaaggaaagaccgcttccggcatgcggggtggtggatctgcggcaggaattaagagagggcaaccgctccatcctaagccgcaggttagacgggctgatggagcagcgcctgcgggcgggagaacagaccatgctctttatcaaccgcaggggcgtggcgggctttgtctcttgcagagcctgcggacatgtgataaaatgtccgcattgcgatgtatcgctgagccagcatgcgaacgggcggatggtctgccattactgcgggtatacggagccggtgccggtacaatgtccggcgtgcggatcgaagtacatcagcgggtttaaggctggaactgagaagatcgagatggttgtcagaaaacgatttccggaagcgcgcgtgctgcgcatggatatggataccacgcggggcaaggaagactacgagcagattttatcggcatttgccaatcacgaggcggatatcctgatcggtacgcagatgatcgtaaaggggcatgatttcccggatgtgacgctggttggcgttcttgcagcagatctctcgctgcatgtcggggactatcgcgcggcggagcggacattccagcttctgacacaggcggcaggaagagccggccgcgggaataagccgggcgaggtcgtcatccagacttatgacccggagcattacagcatagagacggcgaaggcgcaggactacgatgcgttttacgagcaggagattgcgtaccgcaagatcatgctttacccgccggtctggaacatgcttgtgatcttgtgcgcctctaagagcgaggaggcggcggatgccatggcggcagagcttgcggcggcagcggatgcgtatacagggaagaatacgaaagagaaggtctatctcgtgggacccgtcgacgcggcgatcgcaaaagtgaatgatatttataaaaaaataatttatctcaaggcagaaaattatgacacgctggtaaagataaaaaataggacagaagtgtatgccagagagagccggtactataagaatgtgaccgtgatgtttgatttcaatccggtgaacggcttttaggcagaatggaggaaagatggcacttaggacaatcagaatacagggagatcctgtattgaccaaaaaatgcagagagattacagagattacaccgaagatcagagaactggcagaggatatgcttgatacgatgtacgaggcgaacggcgtgggacttgcaggtccgcaggtcggcgtgttaaagcgcatcgtcgtcatcgacatcggcgaaggaccggttgtgatgatcaacccggtgatcttagagacttccggcgagcagaccggcgacgagggctgtctgagccttccgggcaaggcaggcaccgtgaccagaccgaactacgtgaaagcgcgggcgtttgatctggatatggaagagtatgagattgaggggacagagctgatggcgcgtgccatctgtcatgagctggatcatctggacggacacatgtacactgagaaggtggaaggtccgcttcacgaagtcacctatgagagtgatgaggaagaataaagcatggatgatctgtgaaaatggaggtcagtgatgagagtcatattcatgggaacaccggatttcgcggtgggaacgttggaagaaatcataaaagcgggacatgaggtggtgctggttgtctcccagccggataaggcagtgggaagaagcaaggcgctccgctatacaccggtcaaggcatgtgcgttcgagcacggcattgaagtatatcagccgcagaaagtcagagacagcgagtgtatcgagcgtctgcggacatatcatccggatatcataattgtggaggcttttgggcagattataccgagagcgattctggatatgccgcgctacgggtgtgtgaatgtgcacgcgtcgctgcttccgaagtaccgcggtgccgcaccgattcagtgggcggtcataaacggcgacgccgtcaccggagtgacgacgatgcgcatggacgagggacttgatactggagatatgatcttaaaggaagaagtgaagatccgtgcggatgagacgggcggcagtctgttcgaccggctgtccgaggtcggcgcgaagctgtgcgtgcgcacgatggaggcgatcgatgcgggaacggcaacctacacgccgcaggataactcccaggcaacgcataccgtcaagatttacaaagaaatgggaagcattgactggaaacagggcgcaaaagagattgagtgcctgatccgcggactggatccgtggccgagtgcctataccagactgggcgataagatgttaaagatctggaaggcgcaggtcgtttctgaggagtccggggcggagccgggctgcattgtgaaagtggaaaaagatcatattctggtgcagaccggaaagggaatgcttgccatcagtgaacttcagcttgagggcaagaagcgtatgccggtggaggcatttctgaacggatatgagatcgaagagggcacatattttaagaaagggtgattactatgccatattcatactattactggggatttgatccgacgtatatactcgtgctcatcggagcagtcatctgtctggttgcatctgcgagggtgaagtcgacatacaacaaatatgcttcctaccgcagcatgtccggcatgaccggagcacaggcggcggaacggattctgcactcggcaggaatctacgacgtgtcggtgcagcatgtatcgggcaatctgaccgatcactacaatccgtcgaacaagacgctgaatctgtcggattctgtgtatggaagcacgtcggtggcggctgtcggtgtggcggcgcatgagtgtggacatgccattcagcaccagcagggatatgtgccgcttgcgctgcgctcggcgatcgtgccggtggcaaatctcggttctacgctggcgtggcctttaattttaatcggattattttttaccagcaatacagggacatttttgatcgaccttggaattctttgtttttcgttcgctgttctgtttcagcttgtgacgcttccggtggagttcaatgcatcgcaccgcgcgctgcgcattttaggagagcagggaatcttaagcgacagtgagctgccttatacgcgaaaagtgttgaaggcggcggcacttacttacgtggcgagtgcggcggcatcgattctgcagctgcttcgtctggtgttattatttggaggaagaagacgtgacgactgattccgtgaatacgcgggaactgattcttgagatccttttagaagtgacggagaggggacagtacagccatctggtgatccgttcggtgctggagaagtaccagtatctggacaaaagagagcgtgcctttttaacgagagtggcggagggcaccattcagcgccagatcgaactggactatattctggatcagttctcaaaagtaaaggtcagaaaaatgaaaccggtgatccgcgccattcttaggatgggcgtataccagctgaaatatatggacagtgtaccggcatccgccgcctgcaacgaggcggtaaagcttgcgaagaaaaagggcttcggacagctgtccggtttcgtgaacggggtactgcgcggtgtttcgcgcggtctggatcagcttacatatccaaaggagagcgtcgatgccgtaaaagcctggtcggtgtgctactcgatgccggaatggatcgttgcgcagtggatcggcgattacggaaaggaacgcacaaaagagattcttgcagcgtcccttttggaagcgccgatcaccgtccgtgcgaatctggaacggatcacgccggaggcgctcgcagagcgttttaaggaggagggcgttaccgcggttccgctggatacggaaaaatatcccggactttcgtatgcatatacgatctttgggtttgatcatttaaacggtctttcaagctttaaggaaggactgttctatgtgcaggacatcagctccatgatggtggcggaatatgcggcaccaaaggagggcgatcactgcattgacgtctgtgcggcgccgggtggcaagagcattcatcttgcggaaaagttaagaggtaccggtcatgtggaggcacgggacgtcagcgaacagaaagtggcgctgattgatgagaatataaaaagatgccggcttacgaatatcacggcgaagtgtcaggatgcgactgttttggacgagacatcggttcgcacggcggatgtgctgattgcggatcttccctgctcgggactcggggtgctgcgcagaaagaccgatatcaagtaccgcatgaacccggaaggggaggaatcgcttgtggcgctgcagaggcagatactgtctgtggtgtgtgaatatgtgaagccgggcgggacactgatttattccacctgcacgattcacacggcggagaacgaggggaatgccagatggtttgagcagacgcacccggagttcgccctcgatacgatgcggcagatgttcccggaagaacatctcggggacggattttttatagcaaaatttaagcgaaagcaggacaacggataaggaatggaaaagacagacattaaatcgttgaatctggaagaactgaccgcatttgtcgagtcgctcggagaaaaaaagttccgggcaaaacagatttacgagtggattcacagaaagcatgtggcatccttttcggagatgaccaatatttctgcggctctcattgaaaaattgaatcagaactgtacgctgaccagcttaaaaaaggcggatgtgcagatctcgaagattgacggtaccagaaagtacctgtttcttctggacgacggcaatgtcatcgagagtgtcttaatgcgttataagcacgggaactccgtctgtatttcctcgcaggtcggctgccggatgggctgccgtttctgcgcctccacgctggatggtctggtgcgcggtctgcggccgtccgagatgctcgatcagatctatcagatcggaacggacatcggcgagcggatctccaatgttgtggtgatgggaaccggcgagcctctggataattatgacaacctgttaaaattcatcgaactgctgagcgatgaaaacggactcaatatcagccagcggaacctgacggtctccacctgcgggatcgttccgcgcatgcgggagcttgcggataaaaagctgcagatcacgctggcgctttcgcttcatgcatccaaccaggaaaagcgcctgcagctgatgcctgtggcgaacaaatatgacattaaggaagcggtcgatgcctgccgttactattttgaacagaccggccggcgcatcacgtttgagtacagtctggtggcgggtgtaaatgacacggcggaggatgccgcagaactggcagagcttgtgcgcgggatcaactgccatatcaatctgattccggtcaatccgatcaaggaacgcagctatagacagccggatgacggtgcagtgcatgcattccagaaaaagctggagagaaacgggctcaccgtgaccgtgcgccgggagatgggcagggatattgacggtgcatgcgggcagctgagacgcaagcatatgcacaaagagcaggaaatggagcataccgggcaggagacggggtgtgtcgggcaggagcagtaagtcttgccctttttcgcgttgtatgctaacattggtaattggataaatggcaggcaggtactgctattctaataatggaggaatagaatgaagacgttttccatgacgcatgtgggacagcggcgtgagacgaaccaggattatatgtacacatcagagacctccgtgggcaggcttccggatttatttctggtagcagacggtatgggaggccatgcggctggagattatgcttcgcgcttcacagttgaaaagattgtggaatacgtaacagaatccgaggagagcgagccggtgaccgtgctcggtgaggcagtcagatatgcaaatgaacatttgcttgcggaggcgaacgcggatgcgagcaaagcgggcatgggcacgacgattgttgcggcagtcgtggttggcgataagctctacacggcgaatgtcggcgacagccggttgtatgtgatcaaccaggaacgtatcacacagattacaagagatcactctctggtagaagagatggttcggctgggagagatggacaaagaggatgcaaaagtgcacccggataaaaatattattacgagagcgatcggcgtgcttccggaggtgtcggcggatttcttcgagacggtgcttgtgccgggagatacggttctgttgtgttcggacggtctgaccaatatggtcgatgatacggatatcaagcggatcgtgctgggacagcgtgatattgtggagaaaacacaacggctgatcgacgccgcgaacgagaatggcggtaaggataatataacggtggttttgattgagccgttttcagatgagactagatagagaatgaagttctttgtaaatcaggttggaggtttaatatgttaacagagggaatgtatatagcggaccgttatgaaatcatagggaaaattggtgccggcggaatgtctgacgtatataaggcaaaagatcttacgctcggacgttttgtggcaatcaaggttttaaagccggagttttcggaggatctgaattttgtgacaaagttccgcacggaggcacagtctgccgcgggattagaacatccgaatatcgtaaatatctacgatgtcggaagcgaaaaaggaatgcattatatcgtgatggagtatgtggaaggcatcacgttaaagacatatattgagaaaaagggccagctttcttttaaggaggcagtcagcattgccattcaggtgggaagaggtattgaggcggcgcacagcaagggcatcatccaccgtgacatcaagccgcagaatattattatttctacagaaggaaaggtaaaagtaacggatttcggtattgcgcgtgcagcaagcagcaacacgatcagttccgatgtgatgggctccgtgcattattcttctccggagcaggcacgcaacggatttgtggacggcaagagcgacatctattccctcggtattgtgatgtatgagatggtgacgggacgtgtgccgtttgacggggatacgaccgtggcggttgccatccagcatctgcaggaggagatcgttccgccgagtgcctacgctccgaatcttccaatcagtatggagaagatcattttaaaatgtacgcagaagaatccggaccgccgttatgagtccatgacggcacttttgacggatctgcgcaaggcgcttgtcagcccgaatgaggattttgtcgtgatggttcctgcaaccaaccaggacaagacgcgcattatcggagaggacgacttaaagcagatcaaggaggaggcagacagcctctatcttaaggcggatcaggcggtgcacgcgagagcggaggagatgaaccgctacgatgaggatgaggacgacgcagaagatgtggacgatgatgagctggatgacgaggatgacggcgatctgaatccgaagatggagaaagcgattacgatcatgggaattgtcgcggcagtcgtgattgtgattatcatcattgtgattgtggtaaatctgttcggcggaatcaagtccaagaagcagtctgatacggagacgtcgcgcacagagaccacgcagaccgagagccagaatgcagatacggttaccgttccggatttccgcggtacgacttatgcggatgcgcagaccgaggcggagaagaagggattaaagctggagaacaagggcgaagtatcctctgacgactatgatgagggagagatcgccaatcaggacccggagagcggcaaggaagtcgaagagggcacgacgatcggcgttgtgatcagcaacggcaagggcagtgtggaagtgccgagtgtgaccggagactctgaggatgatgcagtgtctgcattggaaaaggaaggtttcaagccgaacaagacatacgcttacgatgacagtgtggaggagggaaaagtcatttcccagacaccgtccgcaggtgataaggcaaaaacaggtgatacgatcacgatcgtcatcagccagggcgcagaggcagtgaccgttccggatgtgaagacgacctacaagtccgaggagcaggcgagagatctgctgtcggattttaatgtgacggtcaagacggcgtacagtgatagttacccggaaggcattgtcatggatcagagtattgatccgggcaagcaggtggaaaaaggcagcgacatcacgatcacggtaagcatgggaccgtcaccgtcccagagtgtgacagcaacgacctacagcttcaaggcgacgatcaacctgccgggcgatacgtccaacgtatccggcgcaacaatcacgctgtatgatacttccggcaatgtgctgggacagtggaataaggcgatcacagatgatttttccatcagcaagacgggactgcttgcaaaagagggctatctggtgatctcatggctggatttaaatggcaacaagatcaacgatcagaccacgagcacctaccagtttacaccggaatcataatggataagaatatgcagggaaagattgtaaaaggaatttccggattctactacgttcacgtagcgggatccggaatttatgaatgtaaggcaaaaggaattttccgcaaccagaagatcaagccgctggtgggcgataacgtgacgattgctgtgctggatgaggagcagatgcttggaaatattgaggagattcttccgagagaaaatgccttgatccgtccggcggttgccaacatcgatcaggcgcttgtgatttttgcggcggcaaagccgaagccaaattttaatctgctggaccgttttctgattatgatggaatatcagaaggtgccggttacgatctgttttaacaagtgtgatcttctgaccggggaggagctgcacgcgttttcggatgtctacgaacagtgtggctatccggtggtgtatacctcggcgagagagcagcggggaatcgatgtgctgcttgagcggctggaaggaaaggtgacgtcggtggcaggaccctcgggtgtgggcaagtcatcgctcatcaactgtctgcagccggagcgccagatggagactggggcaatcagcagaaagattgagcgaggccgccatacgacccgccactcggagattattccgattaaagagcagacttacatcatggatacgccgggattttccacgctggatattccgggactggaaaaggaagatctgtggtggtattatccggaatttgaggagtatgagccaaactgccgttttaagggctgcagtcatatcggggagccggactgcggggtaaaagaggcggtggaagccgggaaaatcagccggctccgttatgagaattacaggcagttatatcaggaattaaaagaacagaagaaatattaaaaagaagggtgtaagagagatgaattgtttgtcgccatccatattatccgcagatttttcaagactgggagagcagatccgtgaactggacgaggcaggggcacagtatgtacatattgatgtcatggacggaatgtttgtgccaagtatttccttcggacttccggtaatccgctccatccgtccctgtacggaccggatcttcgacgtgcatctgatgatcgaggagccggggcgctatattgaggattttgtcggagccggagccgatctgattaccgtgcatgcagagagctgcaagcatctggaccgcacgattgcttccatcaaagagcgggggattcttgcgggggttgcgttaaatcctgctacgccgctgcagacggtggagtatgtgcttgaaaaagtggacatggtgctgattatgacggtgaaccctggattcggcgggcagaagtttatcccgtataccttgcagaaggttcgtgatcttaagaaaatgattgatgcgcgcgggttgaaaacagacattgaggtggacggcggggtcaatctctccaacgtggaggagattatgagtgccggcgccaacatcatcgtggcgggaagcgctgtttttaacggagatgtcgctgaaaacacccagatgtttctggatattttaaattcttaaggaacggcgggagaaaagcgggggagcgtatgaaacattttgtaataatttcaggcggaacgatcgacgattcttttgcggacagatggtttgaggaagagaagccggatgccgttatcgctgcggatgccggaatggaatatctgtaccgcagccaccgggtgccggatgtgattgtcggggatttcgattccgtgggaacggaggctcttgcttattttaagacattgcccggtgtggcgatccagaagctgattccggagaaggacgacacggataccgagtctgcaatccggcttgcgatccggcgcggagcagagcgcatcacgcttttgggagcgacggggacacggctggatcatgtgctggggaatatcgaactgcttggaattgggctaaaggcggggattcccatccagatctgcgatgcccataaccgcatctgtatgattgaccggggaatgactcttgcgagaaaggaacagttcggaacgtatgtgtcgctcattccctatacggaatgtgtggagcatctgacgctgaagggatttaaatatcccctcacggacgcctgcctgcgtggattctgttcgcttggcgtgagcaacgagatcgtggcagatacggcagagatctcgtttgagagcgggattcttcttgtggtggaatcaaaggactgatgacagaagaggattgccgcaataataagcatagaactctttttggggataagtaatattatcagaatatcacaccgtgggatttcagatgaaaatgcagctggaaattcggttcaaaaaatgtggcatttctaaccagccggatgtttgcatcttcgatgatccgtgtctttccaagtttggagcactccgcgggtcatgtccgcatcccggaagacaatttgtaggacttttgtgtgtgtccctaatggcacctctgaacagaacataaccgtgcgaagccgatgtctgtgaagaggtgccattagggacaccagaaagtccgcccattgtctccggtgtgtcggacatgcacccgtcggattgtccaaacgtggaagagacacggaatccgatgcaaacattcagccggaagaaatgctcacatttttctccaacgaatattccatctgcatttccacatgaaatcccgaagtgtattctgataatattacttattaaagctgttaaagataataaacaggatcatgtgtccaaagaattggacacatgatgcgatacactccttttatcagatgacgaaaggagtgtattttttatgaaaggatatgttgtagcggcaggctatatgggatatgtaaacggagaatacatgctcttctcgaatgaggatgactacagagaatattttgaagattagagataaaatgagataaaagaggaaattgccacatgcccaaaagccggtcgtagcgaacggaaggaagcttagaacgctgtctgcggatattgaaattttaaatgggatgtgggataatgtacgcgtaggcaatgagcgggctgcccggcgaagtaaagcagccgccattggtctatgtattgcaaggaaagaaggaattcagatgtcagagaaggaaatcgaactctatggaaaacaggtggatgagatcaagattcggccttatgagcatcacgccaagtattacgagacggatcagatgggcatcattcatcattccaactatatcaaatggatggaagaggcgcgcatggatctgatggagcagatcggactctcctataaggagatggaggcgatggagatcatcagcccggtgctgtcggtgtcctgcgagtatcacagcatggttcattttgatgatgtggttgtcattgagccgcggattaccaagtataacggaatcaagatggaagtggagtaccggatgacggataaggcgacgggagaacttcgcactacaggaacaagttcccactgctttttgaaccgttccggaagaccgatttcgttgaaacggtcttatccggagattgatacaaagttctttgagtacacagatatttagaacaaaatggagcggatagacgctccggaatggagaatactatgattcaggaaagattaagcgcattgcgcgaggagatgaaaaagcggaagatcgatatttatattgtaccgaccgccgattttcatgagtccgaatatgtaggggagcattttaaagccagaaagtttatcaccggtttcaccggatcggcaggcacggcggtcattaccctgacagaggcaggactgtggacagacggacgctatttcgtgcaggcggaaaagcagcttgccggaagtaccgtgatgctctaccgcatgggggaagagggtgtgccgaccgtggatgagttcgttgaaaaagaactgccggagagcggctgcatcggatttgacggcagagtggtgaacggaagctggggcagaaagcttctcgccattgcggagaaaaagaaggggtctttgtacgtgacggaggatctgattgatctgatctggaaggatcgcccggcgctttctaaggaaccgctgtttttgcttgaggagaagtactccggcaagagcacggcagacaagatcgcggatctgcgcaaggtaatggaaaaagagggagccaatgtgcatattctgacttccttatacgatatagcatggctgttaaacatccgcggcggagacatcgattacgtgccggtcatcctgtcctacctggtgcttaccgacaaggagtgcatctggtttttacaggaagaagttgtggatgagaagattgcagcatatctgaaggagaatcacatcacaaccagaccttacgatgcaatctatgattatgtgaaagagatcccggcggacgcatgcgtactgatgaatggcaatacggtcaactaccgcattaccagcagcctgaaaaaagagatccgcattgtggaccagccgaacccgaccgagatcatgaaagcggtcaagaatccggtcgaggtggagaatatccgcaaggcacatgtgaaggacggtgtggcattcaccaaattcatgtactggctgaagaccaatatcggcaagattccgatgacggagatctccgcatcggattacctggaggcgcgcagaagagagcaggataactttatcgagttaagctttgacacgatctgtgcatacggaccgaacgctgccatgatgcactatgcggcgactccggaatcggatgccgagttaaagccggaaggcttcctgctggtggattccggcggacactatttcgagggaacgaccgacatcacaagaacgatggcgctcggaccgatcacagacgagatgcggctgcattttacaacggtatgccgctccaacatgaaccttgcaaacgccaagttcctctacggctgcaccggactgaatctggatattttatcccgcgggccgctctggcagatgggcattgattacaagtgcggtaccggacacggtgtgggctacattttgaatgtgcacgagggaccgaacggcttccgctggagagtggtgccggagcgccatgataacggcacgctggaagagggtatggtcacgacggatgagccgggcgtatatctggaaggcaagtacggtatccgtaccgagaacgaactggtatgccacaaggcggagaaaaacgagtacggtcagttcatgaattttgaaaatattacttacgcaccgattgatctggatgccattgatccggacgagatgacgggacgtgagaagaagatgttaaatgactatcatgcaatggtatacaagacactctctccgtacatgacaccggaagagaatgagtggctgaagaagtatacaagagcaatctagaaacggagacagaaatgagcgaaaagctggtattgattgacggacacagtattttgaaccgggcatttttcggaatcccggatctgaccaattccgagggacttcacacgaacgcggtatacggatttttaaatatcatgttcaagatactggaggaggagcagcccgattacctgacggttgcgttcgacgtgtctgagccgacgtttcgccacaagatgtttgcggaatacaagggtacccgcaagccgatggcggcagagttaaagcagcaggtacccctgatgaaagagatgctgcgcgcgatgggtgtgaccatcgttgaaaaaggcggttacgaggcggatgatctgcttggaaccatcgcaaagcgcagtgaggcggcaggcgtggaggttgcggtcgtatccggtgaccgtgatcttctgcagcttgcaacagatcatatcaagatccggatcccgaagacgaagaggacgggaaccgagattgaggactacaacgcgaaggaagtcctcgagaagtatcaggtgacgccgacggagtttattgatgtgaaggcactgatgggtgatacttccgacaacattccgggagttcccggcattggcgagaagacagcgacggcgatcatcgcaaaatacggcagtattgagaatgcctacgcacatgtggatgaattaaagccgccgagagcaagcacgaatttaaaagagcattatgatatggcgcagatgagcaagacgctggcgacgatcgatatcgatgcggacattgcctacaagcttgcggacgcgcatttagaacaggtttccgatctgtatacagaggaagcctatttgttgtgtaagagactggaatttaagaatctcctcggcagattctccgtggaagcaccgaagaatacggcggaggagcattttaagaagatagaaaaggcgcaggaggcagaagcattttttgcatccctgcgtggaaaagcatgtggattctatgtggtgccacaggaggaaacgcatgacgcccacacggaggctgacggtcagatgaatctgtttggcagctttgcgatgcagaactccggcgaagaggcggggcagcaggagacggcaggaagctgtcatatcccggattttctcggacttgcagttgcatgtggtgaggaggaaatctgttacgtggaggcatcggaagcacttccctgccgtaagatccgtgaattgtttgcggggagcgcagccgcttcctatgcgacacttgacttaaagccgcagttaaaggaactggggatgcttgagaaaaaatgtcttggaacgatctcggaggagaacctgttcgacaacacgatcgcggcctaccttttaaacccgattaagaatgaatatccgtatgaggacattgccaaggattatgcgggactgatgattctgtcgagaaaggatctcatagagaagctcacgtatgagaaggcggctgagaaaaagccggaggaatttttaaagtgcgtctgctatatggcatacgtggcatacaagaccagggagccgcttgaaaaagagcttgcggacaccggaatggaagcgctgtttcgcgagatcgagatgccgcttgtcttcacgctggcagatatggaaaaagagggaatcattgcgtccggggaggcgctaaaggagtacggagacaagcttgccgtgcgcattgacgaactcgagcgtaagatctatgaggaagccggggaggaattcaatatcaattctcccaagcagctcggtgtgattttatttgaaaagctttccctgccgaacggcaagaagacgaagaccggttattcgacggcggcggatgttttggaccgtctggcgccggattacccgattgtggcggatattctggagtacagacagctgaccaagctaaagtccacctatgcggacggtctggtgaactatatcgcagaggacggaagaatccacacgtccttcaatcagaccatcacggcgacgggacgccttagcagcacggagccgaacctccagaacatcccgatgcggattgaactgggaagactgatccgcaaggcatttttgccaaagagcggttttgtgtttgtggacgcggattattcccagatcgagctgcgcgtgctggcgcatctgtccggggatgagaagctcatcgaggcataccggaatgcacaggatattcaccggacgacggcgtcgcaggtattccatatcccgtttgacgaggtgaccgatctgcagcgccgcaatgccaaggcggtcaatttcggtatcgtctacggaatcagctccttcggactcagccaggatctctccatcacgaagaaagaggcggcggagtacattgagcgctattttgagacctatccgaagatcaaggggtatctggacggactggtggcggaggcaaaggaaaaaggctatgtcacgacgatgttcggaagaagacgtccgattccggagctttcttcgagcaattttatgcagcgttcgttcggggagcgcattgcgatgaattccccgatacagggaacggcggcggacattatcaagatcgccatgaaccgggtgcatgaccgcctgctggcggaggggttaaaatcccggctgattctgacggtgcacgatgaactgctggtggagacagcggtagaggaagagcaggaagtgcgtaagattcttgccgaagagatgcacggggcagcacagttgtcggtgatgcttgagattgatgtgcatgcgggaagtgactggtatcaggcaaaatagaggtgcagtaaaacgatgagatttataggaattaccggcggtgtaggagccggcaagtcggaaatactgggatacctggcgaagaagccggatacccgcgtgatgcttgcggatgagatcgcccatgagctgatgtctcccgggacggagtgctatgacaggatctgtgagacgtttggcgcggaggatattttcctgccgcagggcggactgaaccgggggaaactggcggcagtcattttttccgatgaggcgaagcgcaggcagatgaatgccattgtacacccggcggtgcgcgtctatgtggaaaaagaggcggcgagagaaaagcagggtggaaaacgaaagcttctggtgctggaggcagcgcttctgattgaagaacattatgatgaaatttgtgacgaactctggtatatttataccagagaggatattcgcagagaacgcctgatggcaagcagaggatattccacggaaaaggtagaccggatttttgccagccagttgacggaggaagtctaccgggagcactgcagggttgtgattgacaacaacggcagtgtggcggaggcttttgcgcagattgacagggcgctttcggagaagaaatagagattaggagatactgcagatgagcgatacgagcgtattcgaccagccgctggtgtttggtcttgatattggaacgagaaatgtggtgggaaccgtaggctataagacggagaatgaatttgtcgtggtggcacagtatatgcttgagcacgagacgcgtgccatgctggacggccagatccatgatatcggacgcgtggggcataccattgccaaggtgaaggaggagctggagtcacagatcgggcaggaactgaccgaagtgtgtattgcagccgcaggccgtgtgttaaagacggtgacgaccaacatcagctatgatttcccggaggagacggtcgttaccggcgaggatattcatacactggatctgcttggaattgaaaaggcacagtccattttaaaggaaatgaacgatacccgctacaagttttactgtgtgggttattccgtcatgaagtatttcttaaatgatgaaccgttctccagtctggaatcccataaggcagaacgtatcagcgaggatatcatcgtgacgttcctgccggaggatgttgtggacggtctgtacgcggcagtcggtatggcgggtctgaccgtggcaaacatgacgttggagcctattgcggcgatcaatgtggcgattccggagaattacagactgttaaatattgcgctcgtggatatcggtgcgggaacatccgatatttccgtgacgagagacggaagcatcatcgcatacggtatgattccgcttgcgggggatgagatcactgagctgatcgtgcagagttatctggtggatttcaacacggcggagcagatcaagctctcgagcggtatggacgatcaggtgacctacaaggatattatgatgatcgagcacacgattccgtcgaaggatgtgtggaagctgacggagccggtggtggataagatgacgaccgaggtagcggcgaagatcaaggagctgaacggagacaagagcgtcagtgcggcgtttatcgtcggcggcggcggtaagatccacggttacacggagatgcttgccaagaagctggatctgccggcagagcgtgtagcgctgcgcggtgaggaagtgctgcaggaagtgacgtttcttcagacagagatccagaaggatccgctgctcgtcacgccgatcggtatctgcttaaattattacgatcagagaaacagctttatcatggtgcgctttaacggggagcggatcaagctgtatgacaacaataagctgacaatcgtggatgcagccctgcaggccggtttcccgaatgaggaactgttcccgaagcgcggcaaggaactcaatttcaccgtgaacggcactccgcggattgtcagaggtgagctgggagagtccgcagagatctatatgaatgaccgtctggtcaacatcaacaccccgctggaaccgaacagcgacatcgtgatcgaagcgtcgacacagggcgaagcggcggtatgtaccttagagcagctggatgagtattcctcttcggagatgaaggtaatcgtcaacggcaggatcgtgcgctgtccgaagtgcctggaagtcaacggaagtctggaactgccgtcctatgagatcaaagagggcgatgcggttgagacgagaagcttttataccgtggagcagctggcggcattcatggatgtggaagtggacatggatcatgagattcttgtgaataaccgcgtggcaaccatggagagtcttgtgtacgagaacttttccgtggactgggtggtgctttctttcggagcagcggcggtggatccggcagaacttccggttgcggagcagcctgtgacggctgcggctggcgggacggagcagacagcggacgagactctggctgagacggtagaggaagtggatgccgcagagagtgaggcacagaccggtacagaggcggaggaagcggagcatggaatgtcacaggaaccttcatctgtgacagatgccacgggagcagagagcgctgtggagcagccggctgaaggggaagtgcagcaggcttcgcagaagacggatctgggactggttgtgtttatcaatcagcagccggtacgtctgaccggaaagaagagctacatctttgtagatatttttgatttttacgattttgatttaacggcatctgcgggaagagcgatcatcacaaagttgaacggacagcaggcacagtattcggcagtgctctccgagggagaccagatcgagcttcgctggcaggaaattaacagatagagagtggaagaaataaaatggaattatgcagtatagcaagcggcagcagtggcaactgtatctgcgtgggaacagatgaatgtcatgttttagtggatgccggaatcagcggaaagcggattgaatccggtctgaattcgattgatctgaaaacggaagagatgcagggaattctgatcacacatgaacatgtggatcatatcgcaggacttggcgtccttgcgagacgttacggtctgccgatgtatgcgactccggggacgatcgatgcgatactgcacaccaaatccgtcggaacgatcgatcccgccctgtttcatgagattcatgcgggggaggattttacgatcggagatatgacgatcgagccgattgccatctcacatgacgcggctgagccggtggcgtataagatgaagcagcccggaaaatccatggcggtcatgacggatctgggaatttatgacgaccatattgtggagaagttaaaggggctggacgtgcttcttctcgaggcgaatcatgatgtacatatgctgcaggtcggaagttatccgtatccgttaaaacagcgtattctcggagagaagggacacctgtccaacgagctttccgggcggctgctcggggaggtgctgcacgatcatttcggcacggtctttttaggacatctgtccaaggaaaataactatgcggaacttgcgtacgagacggtacggctggaagtggcgatgggagataatccttataagggggatgattttccgatgtatgtggcaaagagagacgagccgtccgagctggtgcggttctaaggtgggagaaaagaaattgcatatgccggcagacacggatatcataaaagaaacaggcgaagagctcttttggaggcaggcgccggaattgaggtagtacgaacaagatgatcaaagaatccgatattcagaattatctatacgccaggaatattccttacaccgaccatgcatcaatctatgcggtgattctgccaaagtattcctttatgcggacgatgatggcgacgatgcttgaggtgcagcattttgtcattcatttcggcaggacgggcatttctgtgatcgtggtgaatgatctcaccggcagactcgacccgtatgggtttttgtttttcccgggggagagaattcagagcgtgcagtttttccggcgggtgacgcacgatcagcttgtgatccggctgacggacggtgtgcgcgtctaccgggtgaataagagaatgatgatgctgccctggcacaaaagcaatctaaaagcattgacttataaaagccctgtgtattataatcagtgttaatacgataaagtgataacgtggaagcaggaggaatgagattggcatggagaatacagtagacaaagtaatcataacagtcgttggaaaagataccgtcggtattatcgcaaaggtatgtacctatctttcggagaatcatatcaatgttctggatatttcgcagacgatcgtgtccggattttttaacatgatgatgattgtggacatgagtcagtcatcgagatctttcggggactgccagaaggatctggatgcggtaggggagcagatcggtgtgtccatcaaatgtcagaaggaagagatttttgaaaaaatgcacagaatctaggaaaatgtgcaggaagatcgaccgatggacataatgtccacagaaagggatagacggaatgattaacatatgggaagtaaatgagaccaacaagatggtggagcaggagaatctcgatgtccgtaccatcacgattggtatcagtcttttggagtgtattgattctgatttaaaaaagctcaatgagaatatctacaaccggatcacgaccgtggcgaaggatctggcggcagtcggagagaagattgagaacgagtacgggataccgattgtcaataagcgtatctccgtgacaccaattgcactggtgggcggtgcagcctgcaagacgccggaggattttgcgacgattgcggacacgctggaccgcgcagccaagacggttggggcgaacttgatcggaggctattcggcgctggtgtcgaagggtatgacgaaggcggatgagatgctgattcactcgattccgatggcactctgccggacagagcgtgtctgcagttcggtgaaccttgcatccacgaagaccggcatcaatatggatgcagtcaagctgatgggagagattctcttagagcttgcggagcagtcaaaggaccgcgattctgcggactgcatgaagcttgttgtattttgcaacgcaccggatgacaacccgtttatggcaggcgcgttccacggtgtgacggaggcggatgcgatcatcaacgtcggtgtcagcggaccgggagtggtgaagactgctctggaaaaagtgcgcggcgagaacttcgaggtgctctgtgagaccattaagaagacggcgtttaaggtgacgagagtcggacagctggtggcacaggaggcatccagacttcttaatatcccgtttggtatcgtggatctgtctctggcgccgacaccggcgatcggcgattccgtggcggacattctctgcgagatcggacttgagtatgcgggagcaccgggaacgactgcggcgctcgccatgctgaacgatcaggtgaaaaagggcggcgtgatggcttcctcctatgtcggcggattaagtggcgcttttattccggtcagcgaggatcagggcatgatcgatgcggtacaggcaggagcgatcacacttgagaagcttgaggcgatgacctgcgtatgttccgtgggactcgatatgattgcgattccgggagacaccaaggcgacgaccatctccggtatgattgccgatgagatggcgcttggcatggtcaaccagaagacgactgcggcgcgcctgattccggttatcggaaaaggggtgggcgatacggtagaatttggcggactgtttggctatgcgccgatcatgccggtgaaccagttctcctgtgacgcgttcatcaaccgcggcggcagaatcccggcgccgatccacagcttcaagaattaaaatataacgaacatgagtcatggaaaataagtgatagaaaacaaccttctctgatcagacagaatccgaaaggatgattcagggaggttgtttttcctttatccggacagaggaagcacagaatggcagagatcagaaaaatcattttcataaaaaatgcggtggagacgctgggatatttttccgaacagattgcacgagaactggagaggaacgggtatgagacctgctttatcgactatgagcggatgtatgagtcgatggatgtaatgctgcattttctggaccgggaagagacggcacttgtcacctttaatttcatcgggctgcgcggggaggctgtgtttcaggcggagagcggacgcagtatctggcaggaggagaaccttcccgtcttaaatatcttggtggatcatccgctctactatcacagctgtctgaaggaagccggggagcggatgcgggtattctgtgtggacagagagcacgtcggctatgtgaggcgtttttacccgggggtgaaggtggagttcctgccgctggcgggcaatgaacttcttttttcgcatggagacggggaacacggaacgcacagagcggatgtgccagagcctgtgctgtatgggcagagaacctttgaccttgtatttgcggccaactatgtgtcgatggagatgctggaggaaaaagtaaaggcgctggatgacgattatcggatcttttaccggcggatcacggaagatctgatcgcggatcccgcgcagtctgtagatgcggttatggagcggcacatccgcaacgagcttggggcagtgccggaagagcagctttgcgcagcgatgtccgggatgatctggattgatctgtttgtccgcagctatttccgggaaaaagtagtgcagacgctcgcggatgccggtatcatagtgcgggtattcggagcagactgggagaaaattcactgcaaaaagccgcagaacgtgcggacgagtggcggaaaagtgaactcggcggcgtgtgtgcaggcgatgcgtgacgccaggatcgcgttaaacgtgatgccctggtttaaagacggagcacatgaccgcgtctttacggcgatgctgcagggaacggcggcgctcacggacgacagccggtatctgcgggaagagtgccgggacggagaaaatatctgcttttactccctgagggcgttacaacagcttccggatcaggtggtaagcctgcttgaggatccggtgcggatggcagagctggcggagcggggatatcggatggcagaaaagcggcacaggtggaagaaccgcgccgggcttctgatgcaggcgcttcgcgatatagataagtaaaactaatagaattcagtaaataaattcatgatactaatgacagcgcattccttgtaaaaagaaaatccgcatgataagatggaagaaggcaatcaatgtagcaatgtgtgatgtgaaggaggaaaatcatgaagatgatgtcacttgcgaaggaactttcgtccaatacatatccgggaagaggaattgtgattggcagatccggggatggaaaatatgcggtaaccgcatactttatcatgggaagaagcgagaacagccgcaacagggtctttgtggaggatggtgaaggaatccgcacacaggcatttgatccgtccaagctgacagatccgagtctcatcatttatgcaccggtccgcgtgcttggcaacaagacgatcgtgacaaacggcgatcagaccgatacgatttacgaactgatggacaagcagcagacattcgagcaggcgctgcgcaccagagagtttgagccggacgcaccgaactatacaccgcggatttccggtatcatgcacatcgagaacaatacctacaactacgcgatgtctattttaaagagtaacaacggcaatccggacgcctgcaaccgctatacgtttgcataccagaatccggtggccggcgagggacattttatccatacatacatgggagacggcaatccgctgccgagttttgagggagagccgaagcttgtcggcatcgagggagacatcgacaccttcacaaacacggtctgggagaacttaaacgcagacaataaagtatctttgtttgtgcgttacattgagattgagaacggaaaatacgagacgagaatcatcaacaagaacgtgtgaggagaataggatcatgaaagaattagaattaaaatatggctgcaacccgaaccagaagccgtccagaatctatatggagaacggcgaactgccgatcaaggtgctttgtggcagaccgggttatatcaattttctggatgcattcaacggctggcagctcgtgtccgagttaaaaaaggcaaccggtcttccggcagcgacctcctttaagcatgtgtcgccggcgggcgcggcagtcggacttccgctttccgaggtggagcgcaagatctactgggtggatgacatggatgtggagtttacaccgcttgcaaatgcctatattcgtgcgcgcggcgcagaccgcatgtcctcgttcggtgattttatctctctttcggatgtctgcgacaaggagacagcgcttgtcatcaagcgggaggtatcggacggcgtcattgccccgggttacaccgatgaggcacttgagattttaaaagcgaagaaaaacggcaattacaatgtcattgagatcgatccggattatgtgccggcaccgatcgagcataaggaagtgttcggaatcacatttgagcagggaagaaatgagctggtgatcgatgaacatttcttcgacaatattgtgacggagaacaaggagattccggaggcggcgaagagagatcttgccattgcgatgatcactttaaaatacacgcagtccaattccgtgtgctatgtcaagggcggtcaggcgatcggtatcggagcggggcagcagtccagaatccactgcacgagacttgccggttccaaggcggacaactggtggctgcgtcagtcgccgcaggtactttcccttccgtttaagccgggcatcaaacgtgcagaccgggacaacgccattgacctctatattggcgaggattacatggatgtgctggcagaaggcgcatggcagaatatttttacagaaaagccgcctgtgtttaccgcagaggagaagcgggcatggctggataagaacacagaggtatctcttggatcggatgcgttcttcccgtttggcgacaacatcgagcgcgcacacagaagcggcgttgcgtatgtggcacagccgggcggttccatccgcgacgatcatgtgattgagacttgcaataaatatcatatggtgatggcatttacgggaatccgtctgttccatcactaggaagagccaaagagggctgatgtatgcagggtgcatcagcccttttttatttcataggaaataccgtgatacattcatgtgtgaaagtagaaccttcctatgaaataaaaaacgctccgcgaggatgcgcagctcgcggtagggaaaatatcgctttgcgaaccgctcgcgcgcggagaatctcgcaagcgagattcttttttacactttttttacaaggctttaccggacaagggtagaagagaagattcataaacgttacagtttattttacatacaagaaaatgagaggatagttgtgaaaatgaagaaaaagaatcattggaaaaacttatgtgcgcttttcttcgcagtctgcatggtgttttcgacagtagcaggagatgcgtcttttgttactgctatggcagcagaggtgcagacagcggccggaagtgaagcggcggaaaatccgtcaccggcagaggagagcggagcagacagcacggaaggtgcacagaacacaataaatcaagaaagtgcggcgcagacagggaacgccggtcagacggacgcagcgcaggcagagggtgcagtgcagacggatgcagcgcagacagatggtgcagcgcaggcggatgcggtacagaatacggagtctggggcagaccagaatacggcgctcatccagacggcgggtgcagaaagccttgcggccttcagttatacggcggcaccggaagcgggacttccgacagcagcgacagcgggcagcggaacgcttgacgtaagcggagcatcttacagcggattcagcaagggaatcgcagcaaaaggatggagcgagggagcgggctttacggttgcggtcaatgctgcaggttacacagatttaaaattttctgcagacatgcgctccagcggaaccggtcctgccaactttgcactggaatattccattgacggagcaagctggacaaagatcagcggaacggatgtgaccttaagtacggatcttgccccggtgtatcagcagacggtactcccggcggcactgtccggaaaagcgtttacactgcgtgtgacaatgcagggaaatacaagtgtgaaccagagtacagtcggcacgaacggtgtgaccagcatcaacaacattgtagtcaccggaacacagggcgaggcggcgacagacggaacggtctgttccaaagtcaaagcttccgtggagccgggagatgtggaagccggtacgaaggtggagctctcctgtgcgacggagggagcaacgatcacataccataccgatctggacagtgcagacaagacatacaccgaagcgcttgtgatcgaggaagatgtgacgatctacgcgacagccgaactcgaaggttatgagacgagtgagacggcagaatttgcctacacggtaaaacagggtgcaaagagcaaggaggcagcacttgccaccacactttcggacggaaatattgtcgccctctattacgagaacaacggaaccggaagcgtgctctcccagaccgcaagcggcaagaagttaaagggcgtgtcagcgactgcggcggatggtgcgcttgccattccggaagatgcggcagaacttacggtttccgtggatgaaaacggctattatacgtttacatgcggtggaaaatatctgacgtccggcgcaacgggcagctccgtgacgtttgcggacgcggcgggagattacagtctctggaagctgcagaaggcaaatgagaacggcggatactatgtgatcaatgccaacgcaaaatataataataccacagaacagtatctggaatattacagcggttttacgacatacagctacaaatcatcttcggatgcggcgtatgtattctatttttatctgatcgatgagggaacaccgtcggttcatatccgtgcggacgagtccgtcacggaaaacgtggcacagtggtccggaacggcagattacaagacggcaggtgtgacggcagataccggaattgcaggagattctctcaatgcaaatgatctgctggatgcggatgctatatattcggcggtggtaaatggaacggcagtggcaccgtataccgaggccacaagcacttccaccggttcgacttcctattatatgggaggaaagggcattggaagcggaagcaatgattatgcgcagtttgtgatgccgacaacgggctatgccaacatggtgctcgcattccggcttcgcgcaagcaacaccggagcaggttccttccagatgcagtattctacggacggtgtggattttaaaaacctttccacaggaacctatgcttataagtacacgaaatacgtgggcggtgagccgcaggaagtgagcgccgcggagaaaattaccgacggtgtggcaaagacaagccttgcgccggcaaactatatttcgttcacgtttgatattccgaacgaggcggcgaatgcagaccgtctctacatccgcatggtcccgggcagcctttctgccaagggagataaggcaccggcagcgggcggagtgatccgtatggacacggtgacagtgacaggcaatccgctgatcgcctcagatctctgcggatatgtggcagcagaaccgcagagcggcgtggtagctgtgggcagtgaattgacactgacaagcgccacggagggtgtaacaatccattacagtgtaaacggcggcgcggagcagatctatgatgcgtcggcgaagccaaagcttgcagaccttccggcagttgtgactgcctatgcgacaaaggacggctataaggacagcatccgccgtacattctcttatcagcaggcacaggtggcaacggtaaaagcaacgccgaacggcggcagcgtggtgaaaaataccgcggtgaacctcacctgtgagaccgagggtgcgacgattcagtattccgcggacgacggtgcaacctggcaggattataccgaaaagctcgccctgacagagcttccggttacctataaggtgaaagccgtcaaagacggttacctggacagcagtgtgctcacactttcctttaccgagcgcacaaacgaaaaatatcagatttactttggacagttacattcccacacttcctattcggatggtgcgggaagctgtgaggatgcataccagcatgcaacgaacgttgacaatctggattttgttgcggtgacagatcactccaactcgtttgacaatgcggacagcgcgtccatctcggacggctcgatgagtgaggaatggaaggaaggccatgcgcttgccacgcagtatacgacaagtggatttgtgtgcatctatgggtttgagatgacctggtcgaacggacttggacacatcaatacgtttaacaccgaaggcttccagagccgtacccagaatgagtacaagacttacagcacggcattgcagaattattacgcgaccttaaagacacagccggattccatcagccagtttaaccacccgggaacgacgttcggtgatttcagcgatttcgcatactatgacgaggagatcgacaagctgattacgacgatcgaggtcggaaacggcgagggtgcgatcggaagttcgggttacttcccgtcctacgagtattaccagcgcgcgctggacaagggctggcatcttgctccgaccaacaaccaggataaccataagggcttgtggggcgatgcaaacacggcgcgttccgttgtccttgtggacagcctgacgcaggaaaatatttacgatgccatgcgcaattaccgcgtgtatgcgacagaggataacgacctcagcatctattacacgctggacggctacatcatgggttccattttagaggatggagcgaccggagataccgtacatctttccgttgacttaagtgatccgacggatgcgtccatcggtaaagtacaggtcatcacaaacggaggactggtgcttgccgagaaaaatgtttccggaaacgaggagacggtcacctttgatgtgaaaaatgattattcctattactatattaaggttgtggaagcggacagtgatatcgccgtgacggcaccggtatgggtaggctctgtggaggcggcaggaattgacagcttttccacggacgaggtgcttccggtaaggggagagccgctgacggtgaaccttggactctataataatgaaaacagcgagctcgcgattgattccataacgtttgaggtgggcggagagaccgtacatgaggcggatcttgccgcagcaggattgggaagcgtcgcatccatgagcacgggaagctacagctttgactatacctatgacggcgtcggcagcatggagatgacagcagttgtgcatgcgacgatgaacggcgtgcagaaggtatacaagagcgtcttaaaattaagctacgcgacaccggagatggtgacaaaggttatcatcgacggaacccattacaacgattatgtgaccggttactatggcggtaacgtcggaaactttacggcgattgcgggagcaaagaacgtcaaggtggaagtggtcacagacgagattacgccggagatgcttgcaaactgtgcgttgcttgtgatctcggcaccggcgaagaaatccgggacagcaaatgccggagattacaccgtgtcgcattttgaagacagctttatccagatggtaaaagactataccgacaatggcggtacgctgattacctgcggtattgccgattatcaggattctacttcgggacagacagcgacagagatgaataagcttttggctgcgatcggggcatcgaccagattaaacagcgacgaggcgtacgatgagacgaacaacggcggacagccgtaccgcttatatctgaaaggaacctacaacaaggattccagatatctgcgcggcgcaagcgaggagcaggagtacagtgcgtacagcggatgtaccgtggcgctggatgcggatgcggtgacagccggacgtgcggaagcgcttgtgagcggatatgatacaacgtattcgatcgactgcaaggatgatgcgggaaacagagttaccggaagcccgacgtatgtggaaaaaggcaatatggtagcactcgcacatgagacactgggaagcggtgcaaatgtctttgttgcgggaaccgtatttatttccgactttgaggtgaaggcggagctggacaatatctgggatctgccatacttaaaccgcacgattgcagaaaatattttagatgaagtgaaagtggagcttccgctgtctacgattgcggaagtgcgtaagaacggtacggcgggcgatgtctaccgcgtggaaggctatgtgaccgcaggaacagccgtggagggcaacaccttctttgatacgatctatatccaggacgacaccgcgggaattgatattttcccgtatgcggagagcggacttgccatcggaaccaaggtggagattaccggatatgtggacgcctaccagggcgataaagagcttaaggtgataagcagccggattctggacgaggagccgaaggtgattgcaccggagaaactgtcggcaaaagacgccatggactatgaaaagtccggcggtaagctggtacaggtggagggaacggtaacggatgtactctatgatgcggcgggcaccggcgtatcacagttctggctggatgacggcagcggcgtcaatgccaatattttcatcgacggatatatcttatcggcaacgacaggaaagaatgaactcgcatcggttgtgtcgacaggaaaacgcgtgtcggcggtcggcgtggtctatgcacatccggagggaacctcggacgaggcagtgacctgtctgcgtgtaagaaactgcgatgagatcgtggaagtgacgtccggggagatgccggatgacacggagacgccgggcaataccgagacaccggatacggagacaccgggagatacaggttcgtcagacagcggaactgacagcgcggacggaaatggaaatggaggaagtgtaagcggcagcgtgactgtatcggacggacagacgacagatgcggtgacggttgcttcgcagaatgactgggatccggtcagaaacagagtgacagcggcatccgccggcagcacagtcacggttctccttgcagacggtgtttctgtgccgggagatgtcattgcggcagtgcgcggaagggatgtacgtctggtatttaggctggcaaatggaatcgtgtggacgattgacggaagaaacgtgacatcggatacggttccggatatggactttggcgtgacgatcaacagccatgccgtgccggatgcgcttgcgagacagaccgcggcgggaagagattatttccagatcagcttaaaccatgacggcgcattcggttttaccgcagtgatgacgctgccggtgggaacacagtatgcgggcatgtatgcaaagttatattattacaatgaagcaaagggacggctggaactggcatcttccggaaaagtagatgcaaacggaaatgtggagcttacctttgtacatgcatccgattatgtggtggtgctggatcagatgcctgcagtgcagacgggggatgacactccgcttgcagtagcagtgatgatgcttcttgcaggtatggttctgcttgcagcggcagcacgcaaaaaaaggatatttttgaaataagggtggttaaaacatgaatttcaaaaagagcaagatacgcagcctggtgcttctggcactggctgccgttgctttttgcggactgatctggttcgcgaataaagacagaccggtttataggagcagcaacatggcggggacggactatgaggtcggaagagtcctgcgggttgtggaggatcacaagacggtggatgaggagatggacggaatctggcggggaagtatgacgctggaggtagagatccttaccggacgttacaagggcgacacggctattgtggaaaattatttcagctccctgtacaacgtcagggtggcggagggggataaaatctccatccgcatcgacacgacgggggaggacgaatatcaggtctcggtctacaattattaccgcgttccgcagatgattggctgcatcgtggcgtttgtgctgcttctcgtattgatcggagggaaaaaaggtgcaaaatctgtggcggggctggcgtttaccgtggtatgtatcctctggattttactgccgcttgcgctgaagggttactcgccgctggcggtcactatcctgctcattctggtctgcaattttgtcagtttcttcctgatagacggcatctcgaccaagacggttgtggcggcaatcggaagcatgctgggtgtgcttgcgggagcagtgtttgcactgatcgcgcagaatgccatgtcgattacgacttaccagatggatgaggcggagacactgcttctgatcacaagcaccacggaactgaagatccgggatctgtttttgtgcggtattctgatttcgtgtatgggagccgtgatggatgtggcgatgagtatctgttccgcggtggcggagatccatcaggtggatcggtcgcttggcatggcgaagctgtttgcctccgggatgaatatcggaagagacgcgatgggaaccatggcgaacacgctaatcctggcagtcgccgggacatcgctgaacatgatgttgatgatctactcctatgacgtcagctttcagcagctgatgaatacggactttgtggcgatcgagattatccagtgcattgcgggaagcgtgggtatcgtgtgtacggtcccgctggtagcactgctgtccgccgccgtatttggaaaaaagacaaaaaaatgagactgcactatggcaggatgacgatctgccgctgatattcggaggcggggggaacgtcatgctcctgcatgcgggcggcgcgcagaggcgtgccgcctttttgattgcgcatctgcagatagagattcccggcaaatacatcgtgctcaaacacctgcatggcatccggggacaaaagctttggcgcctgcgacggccgtgtgataagcggaactgcagcagaggcttttagtgcggcaagcaggggagcggcgcttttccgaaagccgagaatgcgtagatagggaattttatccagggcattgccgcatgcgtaatcggaagaagtaatgccaaggatggagtgcagcaaaatgcggttaatgcgcgtgagagtcatttctttgctttttaaccgtgacgcgaaggaggaaaaagaggtataataaggaagctggtttcgcatgcggttggcaaattccggggaggaatcggcggtccgggcgagttgtgaggcagaactgcttaacagcagataacccagaatgctggaaaagtcatcggcgcacagcagcggaaaatctgcccggtagtcctgcaggatggacagtgcctcctgcggcatggcatgatgcagaatcccgtcggcagaatcttcggatgctccggcgccaccggcgaagagtgtatgccggatcgcggatgcggaggccgggacttcggaggcgccggagcggatggatgtttcgtggtacgcggcgccttcccgctttagcagatagggcgtgatcgaagacgcgcggcggcgcagcgcttttaagtattccagagccagtatgttgttcggggaggcgagcagggaggagagcgcctctgcggatacgggcagggcgccatcctgaccggcggagccggaaaaatacgagagcagggcagcttcccttgcctttgggaatgtactgccggattttaggttgtgcttcagggaagcctttaaatccgccggttcatccgcgagaacgtccgcaatgcggcgaaggagggcaaggtcgccgctctcagcgccaaaacagatgccgtttacgcagcccgttttctcaaagagggagattccggcgtccgcgaaaagctctgcggaagcggtggaccagagtacgggaagctcgagcacgacatctgcacccgaggagagcgccatgcgggcacgggtgtatttgtccagaagggcgggctctccgcgctgtacatagtcgccgcttgtggcgacaacgatatagtcggcgtgaagattttttctgacatgcgcgatctgataggcgtgcccgttgtggaatgggttgtattctgcgataatgccaatgacgttcatggcggatcctcccgtactgcaatgtaataaaaactgtagctatcatagcatactgtgaaatagaaaaaaagaaaaaggagcatttcacgtgaagagaaacagaaacattggagcgattcttctgattgcggcaggacttttgctgattgcggcagccctttatgaactgatcccggcgctgctcgcgtacaagcgggcggacgatacctacgaggcgctgcgcgaggcttatgtgaccggacagccggggacatcttcggatgatccggcggaggagggagaggagctgccggcatggtatgaggcattgcaggtggattttgagacgctaaaggaagcaaatccggatgtgaccggctggatttattttgacaatatagagcagatcaattatcccactctgtattccggggatgacgagacctacctgcataccgatctctatggaaatgcgtcgaaatccggctgcatttttatggaggggaacaatgtccccgattttaacgactgccacacgattctgtacgggcacaacatgaaaaacggaagcatgttcggttcgctgaaacaatataaaaacgacggcttttatgaaaaaaatgcgtattttaccgtgtttacggaggatgcagcctaccgctaccagatttttgcgtacagtgatgtcccggaagattcggacgtctatacgaccgggtatctgccggatgagacttttgacgggttcctcacagagctgcttaagtcttcctacaaggatacgggcgttgcggtgggaaaggatgacaaggttctgacactgtccacctgctcgggtgacgggctgcggtttgtggtgcacgcggtgcgggttgacgaacacgaaagcggggtgtgactgttaaatttttgtcaggctgtttttcattttgtacaaagaaactggcaattactggcttgtttcgcgggcgtgacaagcgtatactaaaactatatgcggtctgtgagagacagacctttgcaaaacaaggaggcagatcctctcctcgccagagggctcggattttgcttcgcaaaacaaggaggatattatgaacgtattagttatcaactgtggaagctcttcattaaaatatcagctcatcgattctgagagcgaagcggtactggcaaaaggtctctgtgagagaatcggaatcgacggaagactggtataccagaagaccggactggacaaagagattacagaagctgcaatgccgacacacaagcaggcaatccagatggttttagatgcactggtgaatccgaagaccggcgcaatcgcaagtctctccgagattgatgctgtcggacatcgtgtcgtacacggtggagagaagttcgcagcatctacacttctgacaccggaagtattaaagacaatcgaggagtgcaacgatcttgcaccgcttcacaacccggcaaacctgatcggtatcgatgcctgcaaggagctgatgccgaacgtaccgatggttggcgtattcgataccgctttccatcagacaatgccgaagaaagcatatctctatggtctgcctcatgagtattatgagaaatacaaggtcagaagatacggtttccacggaacaagccacagctttgtatctaagcgtaccgcagagttccttggtatggatcttaaaaattccaagatcatcgtggcacatctcggcaacggcgcatccatcagtgccgtattaaacggcgagtgcgtagatacctccatgggtctgacaccgcttgagggacttgtcatgggaacacgttccggtgatattgatccggcgatcatggaattcatcgcaaagaaagagaatcttgatatcgaaggtatcatgaatgtattaaataagaagtccggcgtacagggaatgtccggtctctcctctgacttccgtgacctgcaggcaggacacgaggcaggcaacgagcttgcaaccaatgcgatcgaggtattcagctatcgtgtggcaaaatacatcggctcctatgtcgcagcaatgaacggcgtagatgccatcgcatttaccgcgggtatcggtgagaacgtgaacctggttcgtgagaaggtaatgtcttatctcggttatctcggcgtgacggtaaatcaggcagtgaacgatgcaacccacggcgacgaggcgatcatctctaccgcggattccaaggtaaaggtatgcgtgatcccgaccaacgaggagcttgcgattgcaagagagactgtagcgcttgtaaaatagtttttgctgtcaagggaaattccttgacaaaaaagcaaaaaagtgattgacaaaccagggacgcctatgtataattggttaggtgtgaaaacctcatatgtatgaggcgaaggagtaaaccatgcagattgatatttcagagattgtatcttgtgagaacagagaagttaccgagaaggttcatatcgagcaggatacgtttgtatcgaggcttggtgagttcccgatcacgaagagcgcgccgtttgatctcaggattgcgaaccgcgagggcagtgagctgcttttgagcggggagacggatcttacagtatcaatcccgtgcagcagatgtcttacggaagttccgacggacatccacattgtcatcgacaagaagctccgcatggacggaacggaagttgtggatgatgaaatggaagaaacagactacctgattggattaaatctggatatagataagcttatctatggagagattttggtgaactggccgatgaaagttctgtgcagagaagattgcaaaggaatttgcaaggtgtgcggaatgaacctgaataaggggaactgcgattgccagagaacagaactggatccaagaatggcagcaatccaagatgtctttaacaaatttaaggaggtgtaagtaaatgtctatttgtccgaagaataaatcttccaaaggaagaagagataaaagaagagcaaactggaaaatgactgctcctgcattagtaaaatgcagcaagtgtggagagctgatgatgcctcacagagtatgcaagaactgtggctcttacaacaaaaaagaaatcattccgcaggactaattccagcggtacagaggagatccggatctgccgggtctcttttttgtgtaataggaaactccgttcctattacacaaaaacgctccgcggggatgcacacctcgcggtgaggtaaataatgctttgcataccgcgagggcgcgcaagtgtgcggcaagcgcacacttggttctcatggaaactccgtatactctgttctggtattgaaaaaaagtgttaacaaattgttaaaaagtggttactttttttgttccagatatttacaatgatacatgtaacgtcacaacaacaaggaggaaatgttagtgaagaaggaattgaacgagacagaaacgaagcgctccgcaaagagaagcggaatggctcgcagaattacagcacttgttcttgcaggtgtgttgacattcggaggtacggcaaccgtatctgcagcaacattgagagatgtatttgatgcacagtattattctgagacctacagcgatctcaaggatgcattcggtacgaatcagacagcattgtacaagcattataagacatttggtaagagcgagggcagaacaagcacagcacttatcgacgtacagaaatacagagcagcatacccggatctggatgcggcattcggcgataactgggatgcatatgtgaatcactacatcaaatacggctttaatgagggaagaaattctttcggcacctttgatgcaagagcatacgcagacagatatccggacttaaaggcagcattcggttacgatgtgcttgcgctttacaagcattacttaaagttcggtagagcagagggaagagatgcgagcgcagctgtagtagcaacatccagctacacagagtcttcttacagcggatcttctaatacaggaagcgctgacaacggcaacaatacttctaccaacacagcaccgatcagaacaaacggtcgtctgacaaacccggagacaggtgcaccggttgcaggcgcaacagttacattcagactgacaagcttcaatgcaacagcagaggaagcagaagcagctacagagtctgttgagacaacggctgagacgacagagtccacagaaactacagagacaacagagtctacagaagctacagagacaacagagtctacagaagccacagagacaacagagtctacagaagctacagagacaacagagtctacggaggcaacagagtctacagaggagacagaggagccggagaatggtctggttgtaggcgatggttactatgagattaccacagacgcaaacggttactatgagattccggaattcgtaccgggtgtatactccgttcaggcagcagctgttggttacttaaccttgacagtgaactccatcagcatcaacgctgacaatggaagcttcacattgccaacattccagctgttgagctctgatatgagcggtgtgaataccgttgcaggcgttgcaaagaatgcaaccacaggtcttggtattgaaggtgtaaccgtaaatgtacgtgcgaactggaacaatcagtccggtgatgtgatcgctacgaccaccacagatgcagacggcaattacagcttctctcttgagagaggttactacacccttgagttcgcaagagacggattcgtatccacttttgtaaacgtagcaagctccaatgcaattggtgcatgcgaaggcgtattaagcccgaccagcacaagcgaggttaccagcacagaattcagaatcgttcttacctggggtgagacaccgagagatctcgattcccacctggttggattagatgatgccaactctgtattccacatcgcttactacaataaggtagagagagatacggacggtaacgtgatcgcatccctggatgtggatgatgtaagctcctacggaccggagacggtaaccatcgtaaatgcacgtacagatgctacttactattactctgtaaaagactttacagatcgttatgacgctacatccacaaagatgtctgagtctggcgcaaacgtaaaggtataccagggatctgttcttgtgaaagagtacaatgtacctctgaatcaggcaggtaccatctggaatgtatttaagattgagaacggaagcgttgttgacatcaacaactacaatgcagacgagaccacaatgtatggtgagtatgcatccgagtacaattactaaaatgattctttagggaaaaacagccgcggagacgcggctgttttttctttataggaaaacactttgtgctgcgccttttgttccttgaccggggcgttatggaaagctataataaatgaatatggtacaagagaaaaactggtggaaacggattgaagaagaaatgcgtagagtgcatagatgcaggatgaaggcagtgctgacgctttggggtatagggcttttactgggactgggaggctgtgcagaacagacacaggatgctgccggggaagagagcaggacaacggagcagataccgcagagcacggaacagatgccgcaagacagcggacagactggagcggaaacagaacaaatggcaccgggcagcgggcagaccgggacgggaacggaacaagcggtacagagcagtgaaggaaccggggtggagacggacggtgcggaagacactatggaagcggtgttggagcaggcattgccgtcggtggtacagatttatcacgggacgccggagggaggacataccgcgggttccggttttattatggaaatgacggaagatacggtgtatctgtgtacgaaccgccatgtcatagcaaagtacgacgactgggatgtgtatttttatgatggaacctgcgttacgggaagcaaagcgggtaccgacgatgtttatgatgtgggcgtcgtggcggttgaccggacggcgattccaaagaaagtgcaggaaaagctaaagacggtggcgtatgatcttgcgagttgggaagaacttggcaatgcagagttgccggtcggaatcgtgcgcatcggacaggaaggcaatgtgctccacatgctgacgggaagtcttcttcggaaagagacggaattcctgtggggacggggagagaaggagacggaagtgcgcatggcgattaccgacggggattccggatcggcggtttttgatgaaaacggaaagctggtcagcatgatattcggatgttcacaggacgccggaggcgagcgtgactggggcgtcccgcttcgggcgatcgtgtcatgttatgagaaaataacaggagaaacataggagacagaaagaaggattcatatgggtgatttttttaatttggataataagttttttcagggactcagtaaggtggttgactgtgtgatcctaagcgtgctgtgggtgttctgctgcatcccgatggcaacgacatttttcctggcatggcagagcgcatcagtattcggatggattctgtgctggctgacatcgtttctggcgggaccggcaacgacggcgctctattatgcggtcaataaggtaatccggcacggaagaagctatctgtggaaggaatactggcatgcgtttaagagcaactttaagcaggcggcgctcgcagcgctgattctgacaggagtggttctgtttctgggactggactgctatattatgtatcagtttgctgcgcagggacaaaagagcggcgtgctgtatgtggttttcctggtactgattgtgcttgtcgtgatgctggcggtatatctgtttgcctacatggcacgctttgagaacagtctggggcagtcgtttaagaacgcggcgctgattgcggtggcgaatcttccgtggtcgctgcttcttctggtgcttctggcagcgagcgcctttggcttgtggatgcttccgtggcttatgatactgcttccggcagtctacatcctggtggcgaattttatcctggagcgcattttccgcaagtatatgtcggcggaagatctggaggcggagcaggaacgaaatcaggaatttttcaattagaaataagcgtattttttattgttgatttatagaaagagttatagtatattcattagtaggcgtggagaactagactccggcaggacagatgggagatggagtatgcagcagagcagcggggctgtgaggacaagaatcgtattggatgcgatgggcggagactacgcaccggcggagccggtcaagggcgcagtggatgccgtgaacgcacggtcggatattcaggtgctcctggtaggacaggaggatgtcgttcgggaagaactggcaaagtatacgtaccccgaagatcagattcaggtggtacatgcagaagaggtgatagagactgcagagccgccggtgaatgcaatccgcaggaagaagcagtcatccattgtcattggaatgaatatggtaaagcagaaggaagcagacgcatttgtgtcagcgggaagttccggtgcgatcttagtcggcggacaggtgattgtcggccgcatcaaaggcattgagagaccgccgcttgcacctttgattccgacggagaagggagtctctcttctgattgactgtggagcgaatgtggatgcgagagcttcgcatctggtgcagtttgcgaagatgggttccatttatatggagaatgttctcggagtgaagaagccgagagtggcgattgtcaatatcggcgcagaggaggagaagggcaatgctcttgtgaaggagacatttcctctgctgaaggcgtgtgaagacatcaattttgtgggaagcattgaggcgagagagattccaaagggagaggcggacgtgattgtctgcgaggctttcgttggaaatgtcatcttaaagctgtacgaaggactcagcagtacgttaatcggtgccatcaagaaaggcatgatgagcacgttgaagagtaaaattggtgcagcacttgcattgccggcattaaagtctacgttaaagactttcgatgcaacacagtacggcggtgcaccgcttctgggactgaatggtcttgtggtcaagacgcacggaagtgcaaaagcaaaagagattacgaattctatttttcagtgtgtgacgttcaaagaagaggacatcaatggaaagatcaggaaaaatatagtaagttctgcggaacaggaaggaatgtaggttatggaatttgaaaagctgaaaaaaatcattgcagaggttttgaatgtggatgaagaggagatcacgatggagaccacattcgtagatgatctcggagcagattccctcgatatttttcagatcattatggggattgaagaggaatttgacattgagattgcaaatgaagacgcagaacatattgtgaccgtatcagatgcagtagaagagatcaagaatgctttaaactcataagagacaatttgatgatgtgtcataaagcccttgtccggaaagcaagggcttttgttgataagaggaacccgcatggcggcgttgccgcggggcacagagattttgaggctttttcttactctatacaaaggctgtagggcaagaaaagacctccgaaagagacgaggaggataatgaaatgtcaaaactgacagaactggaacaagtgattggttatgagtttaacgagcagagactgttgcagcaggcgctgacacacagttcctttgcgaatgagaagcacatgaagaagctttcggataatgagaggctggagtttttgggagacgcggtcttagaggtcgtgtcgagtgagttcctctacaaggagcatacagatctcccggagggcgatctgacaaagctgcgcgcgagcatcgtctgtgagccgacgcttgcgctgtgcaccagggagattgaccttggaaagtatctgtatctgggcaagggggagaatctgaccggcggaagaggacgcaagtcgattctttcggatgcgctggaagccgtgatcggtgcgatctatctggacggcggttttgagccggcaaaagcttttatccaccgcttcattctgacggatattgaacacaagaagctgttctatgacagcaagacaattctgcaggaagtggtacaggggcattacgaggaaccgcttcactatgaactcatcggcgaggagggaccggatcacgacaaacgtttcctggtggaggcggtgatcgggaatacgacaatcggcgagggaagcggacataccaagaaggcagcggagcaggaggcggcatatcaggcattgctctggatgaaagagagaggtttatatgtatcttaagagcattgaagtgcagggattcaaatcatttgcgaacaagatcgtatttgattttcataacggaattacgggaattgtcggaccgaacggcagtggaaaaagtaatgtcgcggacgctgtgcgctgggtgctcggagagcagagtgccaagcagcttcgcggcgccagcatgcaggacgtcatcttcgcgggtacggagaaccgcaagccgttaagttatgcctatgtggcgattaccatggacaattcggatcatcagcttgccattgattttgaggaagtcaccgtggccagacgtgtgtaccgctccggcgagagcgagtatctgatcaacggaagtccgtgcagactcaaggatgtgacggagcttttttacgacaccggtatcggcaaggaggggtactccatcatcggacagggacagatcgagcgcatcttaagcggtaagccggaggagcgcagagagctgttcgacgaggcggccggcattgtaaaatataaaaagcgcaaggcgacagcacagaaaaagctggagaatgagcgcgagaatctggttcgtgtgaatgatattttagccgagctggagcgccaggtcgggccgttggagcgtcaggcggagaaagcccgcatctacctgaagaaaaaagaagaattaaaagaatatgatgtgaatatgttccttctggaagtggagcgcattgaggcgcagcttaaggaagtggaaggaaaatatcacatcgcggacgaggaatcgaaggaagccagccagtcttacgagaatatcaagagtgaatacgagaagctggaacaggacatggcttccatggatgacaagattgcatccattcgtgaggagatgagccagtccaccgtgaccaagggaaagctggaaggacagatcaatgtcttaaatgagcagatccacacggcggagatgaccgatgagcatttaaagagccgtctggactcgatcgatcgggaaaagcaggagcgcatcgagtcgcgcggtacatacgaagcggaaaagcaggaactcgacacagagcttgcagctgcggcgacggaaaaggagacggcggcagagcagctgcggaacattcaggaggagatcgcgcgctgcaccgagggcattgaaaagggcaagaatgagattatcgaactgttgaaccgcaaggcatccgtcaaggcgagacagcagcgctacgacacgatgatggagcaggtgaacatccgcaaggcgcagctgacgcagcgtctgcttgcgcgcaagaccgaggaggcggatcttatctccgttctggaaagctatcagaaggagctcgatgcggtgaacgcgtcgatcgcagaactgaagaaaaacgctgccgggatggatgagcagaaccgggagtggaagcgcaagtccctggaagccaatcagaagctggagagcgcggttgcacagtaccataagcagcagtcccgtctggagtctttgaaaaatattgcggagcgctatgacggctacggcaacagcatccgccgcgtcatggagcagaagagccgcaacgcgggaatccttggtgttgtttccgatctgatccaggtggacaaaaagtacgagacggcgattgagacagcgcttggcggaaatatccagaacatcgtgaccgaggacgaggagacggcaaaacagatgatctcctacttaaagcagaaccggtacggacgggcgacgtttctgccgctgacgagtgtggacggcaagggcaactttaaaaacacggatgccttaaaggagccgggagtcatcggtcttgccaataccctcgtgaagacggaggaaaaatatgctggagtgaccgcttatctgcttggcagagtgatcgtgacggagaatatcgactatgcgatcaagctggcgaaaaagaaccgctactcgttacatattgtgacgctggagggagaatatttaagcccgggcggttcaatgacaggtggagcgtttaagaacagcagcaatctgctcgcaagaaaccgcgagattgaagaactcgagaagaacgtaaaagatctggataaacagattgcagagcttaaaaaccgtctggaggacatcaagacggcgcagagcctgcttgcggaggacgtcgagagcaataaggcgagcctgcaggaggcgtacattgcgcagaataccgcgaagatgaacgtggagcgcgcgatggagcagaagaacgagagcgagaacgtgtttgcaggcttacagatggagaaccgtgagattgagagccagctccgtgagattgcggagaacaaggacaagattgcagaggaactgcagtcggcaaaggagcgggaggcacagatcgaggaggagagcgccggattccagaagattctggatgaaaatgcgggcagagaggaagaagcccagaaggcagtatccgatgtacagttaaaggaagctgccgtgcgccagaagttagagttcgttctgcagaatctggagcgtgtgaatggagagataagacgttacgaggaagagcgcgagggattcgtcacggaggcgaaggaagcgaaggcggatgcggagaagaagcgccacgatattgaggagatcaaaaagacgatcctggcgtcaaaggacaattccgagcagctggagcaggcactgaaggagcacacggcgcgcagggaagaaatgtcctcggaatacaagggatttttccagaagcgcgaagacatctccaagaaaatctccgatctggacaaggagattttccgtctgaacagccagcgtgaaaagctggaggaggcgcacgagtatcagaacaattacatgtgggaggagtatgagctgaccctgcatgcagcgatggagctccgcaacgaggaatacacggatcttgcggcgatgaagaagatgatcgcgtccatcaaggacgagatccgcaagctgggcgatgtcaatgtcaacgcgatcgaggattacaaggagatctcggagcgctacggatttttgaagacccagcatgacgatctggtcgaggcggagaagacgctggtcggcattattgaggaactcgataccggcatgcgcaagcagttcctggagaagttcgcggagatccagaccgagtttgacaaggtattcaaggagctgttcggcggtggaaaaggaacgctcgaactggtcgaggacgaggatattctggagtgcggcatccgcattatcgcgcagccaccgggaaagaagctgcagaatatgatgcagatgtccggtggagaaaagtccctgacggcgatttcactgttgttcgccatccagaacttaaagccgtccccgttctgtctgctcgacgagatcgaggcggcgctcgacgattccaacgtcggacgttttgcaaagtatttacataagctgacgaagagcacgcagttcattgtgatcacgcacaggcgcggcacgatggcggcggcagaccgtctgtatggtattaccatgcaggaaaagggtgtatccaccctggtatccgtgaatctgatcgagggcgatctcgacaaatagcaggaggaatgagtacattatgggcgaggaaaagaaaggcttctggggacgtctggtcgagggcctcagcaagacgagagataatatcgtatccggcatagattccattttcagtggattttccagcattgacgatgatttctatgaggagatcgaggagattctgattatgggagacatcggcgtcaatgcgactgagtcgatcattgagagtctcaaggaaaaagtgaaggagaatcacatcaaagatccggcagagtgcaaggaacttctgattaacagcatcaaggagcagatggatgtcggcgagacggcataccgctttgagacggagaaatccgtggttctcgtgatcggtgtcaacggcgtgggcaagaccacatccgttggaaagctggcgggaaagctcaaggaccaggggaaaaaggtcgtgcttgcggcagcggataccttccgcgcagcggcgggagaccagctgcaggagtgggcaaaccgcgccggtgtggatatgatcggcggacaggagggcgcagacccggcggcgatcgtctacgatgcggtggcggcagccaaggcgagaaatgcggatgttctgctgtgtgatacggcgggacgccttcataataagaagaacctcatggaggaattaaaaaagatcaatcgtattctggaaaaagaatatgcggatgcgtaccgtgagacactcgtggtgctcgatgcgacgaccggacagaatgcgttaaaccaggcgagagagttttccgagtgcgccgacatcacgggaattattttaacaaagatggacggcacggcaaagggcggtatcgcagtggcaatccactcggagcttggcattccggtcaagtatatcggcgtcggggagacgatcgaggatctgcagaagtttgattccaaccagttcgtaaacgcattatttgaagtaggagaggagaaaagcggatgttgacattagacaagttcgaggaagcaagtgaaaaagtcaaagaagtgacacttgagacaaagctggtatacagcgattactggagtcagcagaccggcaacaaggtttaccttaagccggaaaacatgcagttcaccggggcatacaaggtgagaggcgcatattataagatcagcacgttaagtgatgaggagcgtgcaaaggggctgatcacggcatcggcgggaaaccacgcgcagggtgtggcatacgcagcaaaatgctacggctgcaaggcagtcatcgtcatgccgaccaccacaccgctcatcaaggtgaaccgtaccaagagttacggcgcagaagtcgtgctctacggagacgtctatgacgaggcgtgccagaaggcatatgagcttgcggacaaggagggatataccttcatccatccgttcgatgatctggcagtggcaaccggacagggaacgatcgccatggagatctttaaggagcttccgctggtggagtacattctggttccgatcggcgggggcggactggcaaccggtgtgtccacactggcgaagcttctgaatccgaagatcaaagtcatcggcgtggagccggcgggagcgaactgtatgcaggcttccttcgcggcaggaaaagtaacgacgctgccgcaggtcaacaccattgcggacggcacggcggtcaagacgccgggaagcaagattttcccgtatatccagaaaaatctggatgacatcatcacggtggaggatgatgaactcgtcgtggccttcctggatatggtggagaatcacaagatgattgtggaaaactccggtctgctgaccgtagctgcgttgaaacatctggatgtttccgacaaacgagtggtatcgatcttaagcggcggcaacatggacgtcatcacgatgtcctccgtggtacagcagggactcattttccgcgaccgtatcttcaccgtgtcggtacttctgccggataagccgggagaactgtccaaggtttcggcagcgattgccgcagagcagggcaacgtcatcaaactggagcacaaccagtttgtgacaacgaaccgcagcgcggcagtggaactccgtattacgctcgagagctttggcaccgagcacaaaaaacagatcatgaaagcgctggagaagaaaggttataagccgaagctggtgcgcacgagtctgtaaacaaagaggaggagaaagaaaatgttagaaaagtggtttaaactgaaggaaaacaacacgacagccaagaccgaagtcatggcaggtatcacaacctttatgacgatggcgtacattctggcagtcaacccgaccatgcttgcagcggcgggaatggataagacagcagtgctcattgcaaccgcgctggcatcatttattggtaccatggcgatggcgctccttgcaaattatccgtttgcactggcaccggggatgggactgaatgcgtattttgcatacacggtctgcggtgcgatgggatattcctggcaggtagctttaatggctgtttttgtggaaggtctggttttcatcgtactttctttgaccaatgtgcgtgaagcaatctttaatgcgatcccgctgaacctgaaaaaaggtgtgagcgtcggcatcgggctgtttatcgcatttatcggtctgcagaatggcggcatcgtagtggcgaacagctccacacttgtttcctatgttgactttaccagcaatttcaagactgccggcatctgtgctttgttagcgctgatcggtctgtttgtgattgcaattatgtacattaagaacgtaaaaggcgcgattttattcggtatcgttattacctgggtgcttggaatgatctgtcaggcggcaggaatctatgttccggatgcggaagccggtttttattccttatacccggcgctcggatttaccgacctgaccgcgatcggtcagacattcggacagtgcttcaaactggatttctccaatgtgcgtgtctttgacttcatcgcagttgtatgtgcatttttgtttgtagatatgtttgatacactcggaacgttaatcggtgtggcaaataaagcggatatgttggacaaggacggcaagctgccgcgcatcaaggaagcgctgctggcggatgcggttgcaaccaccgcaggcgctgtgctcggtacctccacaaccaccacgtttgttgagagttcctccggtgtggcagcaggagcaagaacaggtctctcctctgtagtgaccggattcttattcctgatctctgtggtactgtccccgattttctgctcgatcccgagctttgcgacagcaccggctctgatcttcgtcggcttccttatggtgtctacggtgacaagcatcgagttcacggatatgacagaggcaattccggcatacttatgcctgcttgcaatgccgctcatgtacagcatctccgagggtattgcgatcggcgttatctcttatgtcatcatcaatgtcgtatgcggtaaggcaaagaagatcacaccgctgatgtatgtgctggcggtactgtttgtgtgcaaatacatcttcttataaaatgaaaaccgaaggtatggaggtatccctatgcgcagatggataaaacagatcatggtttggcttgttgcggcagcgtgcggttttgctgcggcgcttgtgatctgcagatggagcggtactgccttcggtcttttcatgtggccggtcattgccgcgggagcagggttcgtggtggccggcgtgggatttttttcaacagaaggaaagagtgagattctctacggaatctgtgcggcggcatgcctgttctgcatgatcgtgcagacggcgatggcggtgtaaaaagaaggaaaaagtgtgtcaagaaaaaatacttgacacctttttccttttatgctattctatcacggtggcaatgagtgagagatgccggatacggcgtgattgtgggatttcagatggaagagaagattgaacaggcgtatctgtatgatttttacggagaactgctgaacgaacatcagagaagaatttatgaggatttcgtgttcaatgatctgtctctcggagagatcgcggacgaggaaggtatcagcagacagggcgttcacgatatggtgaagcggtgtacgaagacccttgaggggtatgaggagaagcttcatctgatcgcaaagttcatgtcggcgaagcgcagcgtggaacagattcatgcattgacgaagcagtttcatgagagccatgacgaggcagtgatcgtggagattgaacagatttccaatcagatattagaggagttatagatggcatttgacagcttatctgaaaaacttcaaaatgtattcaagaacctgcgcagcaagggacggctgacggaagcggatgtcaagacagcgcttaaggaagtcaagatggcgctcttagaggcggatgtcaacttcaaggtcgtcaagcagttcgtcaaggacgtggaggagcgtgccgtcggacaggacgtgatgaacggactgaacccggggcagatggtcatcaagattgtaaacgaagagatggtcaagctgatgggctcggagacagccgagatcacactgcagcccggcaaggcagttaccgtcatcatgatgaccggtcttcagggagcaggtaagacgaccacagcagcaaagcttgccggaaagttcaagcagaaaggcaagaaggtacttctcgtggcaggcgatgtctatcggccggcagcgatcgaacagttacagatcaacggacagaagcagggcgtggaagtattttccatgggcgataagaacagcccggtgaacattgcaaaagcggcgatggaacatgccgcgaagaacgattttaacatcgttatcatcgatactgccggacgtcttcacatcgatgaagatatgatggcagagttgattcagataaaagaaaatgtcacagtgcatcagaccgtccttgtggtggacgccatgacaggacaggatgcggtgaatgtggcgaagacctttgatgagcgcatcggtatcgacggagtcattctgacaaagctcgacggtgataccagaggcggtgcggcgctttccatccgggcagtgaccggtaagccgattttttatgcgggtatgggagagaagctttcggatctggagcagttttacccggatcgcatggcatcgcgtattctcggtatgggcgatgtgctgaccctcatcgaaaaagcccaggaggactttgacgaggagcgggcgaagaagattgagcagaagatgcgcaagaacgaatttgactttgagatgtatctggagtcgatgagtcagatgaagaagatgggcggtctgtccagtatcctcggtatgatgccgggactcgggatgggcgcaggcaagatgccggatattgacgaggcagcagccgagaagagcttatcgcgcacggaggcgatcatctattccatgacgccggaggagagacagaatccttcccttttgaatccgagcaggaagcgccgtattgcggtgggagccggtgtcgatattgcggaggtcaaccgtctggtgaagcagtttgaacagatgaagaagatgatgaagcagatgcctggcatgatgaagaagggcagacgcggtggtggaatgttcggcaagcttccgttttaatgttagaaattgcgtataacgcattctaaatagatcagttaagcaaatttaaggaggtgaaagtaatggcagtaaagatcagattaagaagaatgggacagaagaaagctcctttctatagaatcgtagtagcagattccagatccccgagagatggcaagtgcatcgaggagatcggaacatacgatccaacgaaagatccaagcgagtatcatgtaaatgaggagttagcaaagaagtggttagctaacggagctcagccgaccgatacagttgctcgtattttcaagagcgcaggcatcgagaaataggattcgcgaggtggacctaatgaaagaattagtagaagtaattgcgaaatcactcgtcgattatccggatcaggtcgtcgtaacagagacagagaatgagaaagccatcgtgcttgaactgcgcgttgcgcagtccgacatgggcaaggtaatcggcaaacagggacgcattgccaaggcaatccgttctgttgtgaaggctgctgcctcaaaggaagagaagaaagttattgtagagatcatgcagtaacaggtcagaggagctgtcgcgccagataatggggtggcagctcctttgttcatattgcggctactgcggatatcagagacagaaacggaggacatgcatggaagatttattgcaggtcggtgtcatcacgacgacacacggggtgcgtggggaggtcaaggtatttccgacaacggacgatccagcgcgcttcaaaaaactcaaaaatgtgattttggataccggaaaagaaaaattagaacttgagattgcaggcgtcaagttctttaaaaatatggtgattctcaaatttaagggaattgatgatatcaatgatgtggaaaaatatcgcaaaaagagcctttatgtgacgagagagaacgcggtaaagctgaaaaaggacgaatactttattgcagatctgatcggcatgaaggtgtcgacggacgagggtgaggaattgggaacgctgtcggatgtgatgcagaccggcgcgaacgatgtctatgtgatctccatgacagacggggaggaagtgctcattccggcgatcagggactgcatccgcgatgtggacgtagagcagggacagatgtgcgtgcatctgcttccgggactgcttgacatcaaccgaaaataggaggcacagcatgaattatcatattctgacactgtttccggagatggtgacgcagggactctcggagagcatccttggacgtgcggcaaaaaagggactgctgtccgtgaatgcagtcaacatccgggattatacggcggatcgacataaaaaagttgacgattatccttacggcgggggagccggcatgctgatgcaggcgcagccggtctacgatgcgtggaaggcagcctgcgaggaaatcaggagccggcagccggaggagctgcgggacagaccggtgcgcacggtgtatgtgacgccgcagggagccgtgttcaaccagcagatggcaaaggagttcgcgaaggaggaagatcttattttcctgtgcgggcactatgaggggatcgacgagcgtgtattagaggagaccgtcacggactacgtgtcgatcggcgattatgtgctgaccggcggggaacttccggcgatggtgatgatagacgcgatctcacggatggtgcccggggtactggcgaacggagagtccggggagacggagtccttcgagggcgatctgttagagtatccacagtacagccgcccggaggaatggcacggaaagcaggtgccaaaggtgctgctgtcgggcaatcagagaaaaattgccgagtggcgcagacaggaggcggagcgccgcacacaggagaggcggccggatctctacgcaggctacgagagactgatgtcctgcaaaaaggtgcttgccggggacaagctgctgcatgtggatatgaccgagctgattgcgcgcgggcaggcgcgccttgtttttgcagaagggaaaaatatctgtctgcaggataaagtcagtggggcgtattttcatacggcggaggacatcaaagccggctgcaggatgcttgaaattctacacggggacgccggggaggagagcggccttctggtgctgcatcaggagttcatgacggaaccggcagaaaaatatctgggatttcgcacggcgatgacctgcaaccagatcgtgtatacaaagcacgaaaagctgcctgtcaccggactgtaccgcatggacggcaaaccggctgaaaacggcgtggtcatccgtccgcttacgatggaacacttagacgcggtggtgcgcgattacaatacgatatcggatgaggcgtatgtgacagaccggatcaaaaaaggagcgctcttcggtgcgtttgtggacgggcagcttgcgggctttatcggaatgcacgcggagggcggcatcgggatgctcttcgtctcgccggagtaccgcagacgccggatcggcatggcacttgagacatatatgatcaatctcggattagagcgcggtgagagaccctacggtcaggttgagatcggcaatgatgcatccaaaggactgcaggaggccctgggactctgtttttctaagggacgcatctactggatggagcgtgaagagagagaatgaaaatatttgccgaaaatgcttgcaatccgtacaatctgtgttatactggaatagttgtgaataaatagatggtcctctgttacgaattgacgtattaagaacatccaatgaatcaggaggtcacaaaatgaacgcaagtgaaatcattaagagcattgaagcagagcagctcaaggcagaagtaccgcagtttaacgtaggtgatacggtaaaggtttacggtaagatcaaagagggtaaccgtgagcgtatccaggtattcgagggaactgttttaaagagacagggcggaagcaaccgcgagactttcacagtcagaaagatctctaacggtgtcggcgtagagaagacctggccgttacattctccgaacgttgagaaggtagaggttgttcgtcagggtaaagtcagacgtgcaaagttattctacttaagagaccgtgtcggcaagaaggcaaaggtaaaagagcttgtaaaataatacaatgcagcgctaagaagccgggacatattttgtatggaacaggattccatatggagtgtgttccggtttttttcgtattataaggcaccaaaattaaattgcgaagccacagggtttgtgttaaagtaaagcaggaatcgtgtgcggcgggcacacggcacatggaggataagaatgcgcagacgtagaagcggactgaactttggcagacagaagaaaaaagtgaatatgtcggttgtgaaggaagcgtgtgtgtggatcattgagatcgcgatcacactgctggtagcgtttacactggtatattttgtcggactgcggacgagtgtcgtggggcagtccatggcggagacgctaaacggcggggatgagattctggtcaaccgttttatatacaaagtaaccgatcccaggccgaacgatgtgattgtatttttaccgaacggcaatgaaaagtcacattattacatcaagcgcgtcatagcggtgccgggggatacgcttcagattaagaacggcgaagtgtatgtcaacggcgaactgtttgcggaagatgtggatgtggcgcagatggaggatgccggactggcggcggaagagatcacgctgggtgaggacgagtatttcgtgctcggcgacaaccgcaataacagcgaggacagccgctatgccaacatcggcaacattaagaaggaatatattatcggaaaagtctggttccgcgtggcaccgtttaaggactttggatttttataaaacagacagtaagagaatggagagtaattatgcagtttcagtggtacccggggcatatgacgaaggcaaagcgtcagatgcaggaagacattaagttaatcgatctggtcatcgagcttgtcgatgcgcggattccgctcagcagccggaatccggacattgacgaactgggcagaaacaaagcgcggctgatccttatgaacaagtcggatcttgcggacgaggaagcgggaaagctgtggagtgcgtattttcagaagaagggctattatgtggtaagcctggattcgagaaacagaaacggcatgaagcaggtgacggcggtcgtcatggaggcgtgcaaggagaaaatcgagcgcgacagaaagcgcggcatcatgaaccgtccggtgcgggcgatggtcgttggaatcccgaacgtggggaaatccacgtttatcaattcctacgccggaaaggcgtgcgccaagaccggcaacaagccaggcgttacaaagggcaagcagtggatccggctgaacaagaatgtagaacttctggatacaccgggaatcttatggccgaagtttgaagaccagacggtcggattaaaactggcgttaatcggtgccatcaaggatgagattttaaacatcgatgagctgtccctggaattgatcaaagtgctgaccgcctactatccgggagcgcttcaggcgcgctatggaacggaggagctggatatcgacgagacggcggcgccggcagagatcctgcgtgggattgcggagaaccgccgctgtgtggcgaagggcggcgagattgactacagcaaggcggcgacgcttctgattgatgaattccgcagcggaaagcttggcaggatcacactggagcggcccgattagcacaggcagcgggaacatacggcgggagaggaagcagatggagacgaaaaagatcggagaaatcagggaagaattcaaggcggcagaggagaacatgctgccttcttttatcgaaaaatacaggtcggacgagcgcgcgggcgtacaaaagctcatcgagcaggcgaacggacgcctcgcaaagctggaggcggagcgtgcaaggattgaccggctgtggaggtatgagcgcgagtacgggatgtatacgcgtatctgtgggattgatgaggtggggagaggtccgcttgccggccccgttgtggcgggagcggtcattctgccgaaggactgcgacatcctctatatcaacgattccaagaagctctcagcggcaaagcgagaggaactgtacgatgtgattatggaaaaagcggtggcggtcggcatcggcatggtgggaccggagcgcattgatgagattaacattttgcaggcaacgtacgaggcgatgcgggaagctataagcaaattgggcgatgcacccgatatattattaaatgatgcggtggcgatacccggggttgcgatacggcaggtgccaatcatcaagggagatgccaagagcatctcgatcggcgcagccagcattgtggcaaaagtgaccagggaccggctgatggtggagtacgacaagatcatgccggggtacggattcgccgcgaataagggttatggctcggcggaacatattgcggcgctgaaaaaatacggtccgacgtcgattcatcgccggagctttattggaaattttgtagaggtttagacgggaagagggaacatacatgcagatatcggatctggtaggacagtacagccggaatgtggccaacggaacggaagaattgcatggggcgcagagcgttcagaaactggtgtcgacgatcggggatctctccgcgggaagtattttcgaggggacgatcaacagtgtgcgcggcggaaaagtgacgctggcgctgggcaatggacagaccatcaccgcgcggctggacggaaaaatggatttacagcagggctcgagcatgtttttccaggtgcgcgccaatgacgggcagacgattgcgatccgcccgtacaccgagcttggaaatgtcagcaatccgattctgctcaacgcgctttcggcggcgcaggtgcctgcgacggaccggacgcttgtgatggtggatacgatgatgcaggagcagatgtcgatcgacagacagagcattctcgatatggcgaagctggttggcgcgaatccggatgccaatgtgcagaccatcgtgcagatgacgaagctcggactcccggtgacggaggagatggcggcgcagtttgaaaattatctgtccgaccggcaggcactcgtgggagagatggatctggcagcgggacatatgatggaactgctttcggacgaggcgctctcgccggagacggcgttttctctctatgagaaaatgctcgatatttttatgcccggggcggaagcggcagatgccggagtgaccgcggcagcgggacaggaatcttccgcagcagaggcaggcgccggagtaatcgcggaagcagtgggacaggaaaatgcagccacggtggcagaagcagaggcgggcgcgcccacggcggcggaacagggaaccgcagcggcatcggcagtggcggagaaggcaggtgccgcttcgaccacggagacagcgggacagggcgcagcggcagaagcagagacaggggtcggagtgaccgcggaactgacatatggaaggacggcagagactccggggacagtcggggaactgttgtcgaaggagcagatcgagcatctgggaaaaatgcttcggaacattccggctctgattggcaacgaggagatttttgccggcggagagcaggaggaagtctttgtggatacgctctcggaagaaggtccggaggtggcgaaactgatggcgcaggaggaagcggcgcaggagcagccggtcttgaatgaaaaattgacggcagaacagtttttacagaagctcggcagagcgctcgcacagaatggcgggttcggctttgcgggaatgcagaagctttttgccggaaaggaatttcagaccattttccgcagtgtgatcgagaagcagtggcttctgcagccggaggaattaaagcaggagcataaggtgagcgggctgtatgagcgcttagagcagcagctttcccagatggaggaggcggttcgggcgaccggaagcacgcagaatacgtttttgcagacggcatcgcaggttcacggcaatctggagttcatgaatcagatgaaccagatttatcactatgtgcagctgccgttaaagatgtccggacaaaatgcgaacggggaactctatgtctatgcgaaccggaagaatctgcgcgatccggatgcggaactgacggcatttttacatctggacatggagcagctcggctccacggacgtctcagtgcggatgcagaaccgcagcgtacgcaccaatttttatctggaggatgatgcctcctatgatctggtggaaaagcacctggaagtgctgaacaagcgtcttaagagcaagggctaccagtcttccatcacggtcacacatgagaaaaaagacatcagtttcaaggagaacatcgtaaagaaaggaaaggcgacggtgggaagcctgcaccgctattcttttgatgtaagagcataggaaagcaggattctttgaagggaggatgtggcgatggcggagaacaagcatattgcaggaaaagaaaagacggcggtcgccgttgcctacaatccgggcgaggtggcgccgaagatcctcgcagtcggaaaaggcgaggtggcggagcgcatcattgagacggcaaaagaaaacgatgttccgttttatcaggataacaagctggcggagaccttatccagacttcagatcggggatacgattccgccggaactctacgaggtggtcgcggagatccttgtctttgtggacgatatggaccgcatgaagggaaaactcaaagaatccggcttactgtaggcagatgacagatgccgtgatggtaacagaaggcacgggaagaacccggacggcggaacgtggtgatggatcggacgaaaggcagggagagaggataccggatgaacaggcggcagacgggaacagcgtatgagagacgggcgggggagtatctgaaggaacagggatacgagctgattggatacaatttcagatgccggcagggagagatcgacatcatcgcccgcgatggcagatacctggtgtttgtggaagtgaaataccgcagagacgggcagacgggcgatccgctggaggcggtggaccgggcgaagcagcgccgcatcagcagaacggcgcaatattactgcctgacgcacggatatggggagacgacgccctgccgctttgatgtggcggcggtgcttggaacggacggggaagtacggcttgtgaaacatgcatttgaatttcagggatgacgggaggatgagacttgacagcgtttgtgagaaaaccagcagaacaaccggttttgcgggaggactggcatgaaaatgaggacggcagcaggcttctgctgctaaaatatccccttttggagcgcacggggatcgtggagcattgttttacaacacggctcggaggtgtcagcacagacattttttctacgatgaatttaagctttaccagaggtgatgaggaggcggcggtgcgtgaaaattaccggcgcctggcgagggcactcggggcagaggtggggcagtttgtctgctcggatcagacacataccgtcaatgtgcgccgcgtcacggcagcggacgccggaaaaggactgaccagagagcgggactaccgggatgtggacggactgattacggatgagccgggacttgtcctgtcgacgttctacgcggactgtgtgccgttatatgtggtggatcccgtacaccgcgccatcggaatgagccattccggatggagaggcacggcggcgcgcatgggagcggtcactctgtctgccatgcaggaggcatacggcaccagaccagaggatgtggtctgcgcggtcggtccgtccatttgcaaggactgctatgaggtgagcgcagatgtggcagatattttcgcggaggaatttccggggcatgagcaggagattctggcagagagtgagaagaacagcgtcgggatggctcacgcagacaaaaaataccagctggatctctggaaggcgaacgagatcatttttcaggaggcgggcgtgcgaaaagagcatctggcagtgacggacatctgtacctgctgcaatccaaagctgttgttttcccaccgcgcaagtcatggaaagcgcggaaatctgggcggatttctgtacctgaaataaggatgtataagatcgtccttcaggtatggtctgtagatagaatcaaatagaaagcggaaaaggagaaaaaagatgaagacaaaaaaatatgtggaatatatggtcgaggagacaaagaagattctggcaatcgacagtccgagcggatacactgcagaggtggcggattatgtgatgaaagagtaccagaagctcggctatgagccgaaactgaccacgaaaggcggcgtgcttgtggcgcttggcggcaaggacaaaaagaatgccgtgatgctcgaggcacacattgacacgctcggcgccatggtagcggagataaagtccaacggcagactgcgcgtgacaccggtcggcggaatgaacgccaacaatgccgaggcggagaactgcagaatccatacccgcttcggggaaaaggtctacgagggaaccctgcagcttgccaatgcatccatccatgtcaacggcgattacaatgacaagaagcgtacatttgacgagacggagatcgtgctggacgagaaggtacattccagagaggacgtggaggcactcggcatcatgacgggagacatcgtctgctttgatccgcgcacgaccgtcacagagagcggctacatcaagagccgtttcctggacgataagcttagcgtcggcatcctgcttggctatgcgagatatttaaaggaagagaatgtcacaccggagcgcatgatctaccagcacatcaccgtctttgaggaagtcggacacggcggagccgcttcgattccggagggtgtgactgaggttatttccgttgacatgggctgcgttggagacggtcttgcctgcgaggagacacaggtgtccatctgcgcgaaggacagccacggaccgtatcactacgacgtcgtgacgggactgattgcggcggcaaagcgcgaggaacttgactttgcggtggacgtctacccgcattacggatcggatgcggatgtggcgctgacggcgggctatgacgtgcgccacggactgatcggcgcgggcgtgtacgcgtcgcacggctacgagagaagccatgtggacggcgtgaagaacaccttcaaactcctgtgtgcatatctgggctgatgccgaagttaaataaaagttaataatttcataggattatctttattgtatgagggaaccttccatgctatagtagctgtattaagacaaatagtacagttggtacagatgggaggttatgatttgattcagttaaattaccgggactccaaaccgatttatgaacagatcaaggatggctttcggaagctgattatcacaaattctctttcggcaaacgagaagctgccgtctgtccgcgaactggcgtccggactggcgatcaatcccaatacgattcagaaagcgtatcgcgatctggagagcgagggatatacatacacggttgccgggaagggaacgtttgtggcggagcacagggaaatcctgaatacgagacagcatgaactgctggaagagttcgatgaagtggtggaggagctctgtttcctgtcagtgagcaggagcgatctgatcacacggatcgaacatgcggcagagggaggagagaaggtatgattcaggtaaacggattaaaaaaggcatttgacggatttgtggcgctaaacggtgtggacatgcacgtggaaaagggagccatctacggtctggtcggaccgaacggagcaggaaagtccacactcatccgccacctgacgggggtgtaccgtccggatcagggagaggtgcagatcgacggggaaaatgtatatgagaataaggcggtcaaatcaaaaatcgcgtacataccagacgaactgttttatttcatgcaggcagacacgatggagatgaagcgtttttatgaggggatctatccgtcttttgatggaaagctgttttaccggatgcaggagtttttcccgaatattgatgtgaagcgcaatatcagacggctgtcgaaaggaatgcagaaacaggtggcattctggcttgccatctgctgcaagccggatattctgattctggacgaaccggtggacggactcgaccctgtgatgcggcgtcagatctggagcatcatattgtcggaggtcgcagagaaagagatgaccgtgcttgtatcgtcccacaatctgcgtgaacttgaggatgtgtgtgaccatgtcggtatcatgcatcatggaaaaatcatgatcgagcgctcactgagcgacctgcagggaagtgtgtcgaaaatccaggtggcgtgtcagagcggaatgccgaagcttccggaacattttcaggtgcttcacatggcaaatacagggcgtgtgtataccatgatcgtaaagggagatccaaaggaagcagaggcggcactgtcatattgcaatccgacgattgtggatgtactgccgctgacactggaagaaatatttatctacgagatgggaggggcagattatgaagtcaaagacatcctgttttaaccgcacgatatttaagaagaacttcacgcatttctggccgctgtggctgctttaccagatatatctccttgtggtgattcccgtatgggtgtggcagaaggctgccagtccgtactactattatggaacggggaacgaggacacaacctaccgcatgtatcagctggtggagctggcagtacaccggatgatccctcctctgccggtctttttcttcgcagtggcagcggcgctggcagtgttttcctatctgtattcggcaaaaagcgccaatatgatgcatgcgttgccggtcaaccggctggaactttatgtgacgaattatctgtcaggactcatttttctgatcgtgccggagatcatcacattctttatcacagtgctcgtatgcctggcaaaccagtttacctgtatacagtatctgttcgctgcgctgttggcacaggctggtgtgacattttttgcatactcacttgcggttttcgtggcgatgttcacagggcaggcgtttgcaatgccatgctattatgtgatcgtcaactatctgtatgtgggatgcatgtttattgttgcaaaggtgattgaaaccatcagctacgggattgagaatgcatggaatccgggaaaaagctgcattttatcgccgctttattatctgaacaataatcttcgcagcagtcttatctacacggagaatgggaatggaattaccggcattaagatcacgggcatgccgctcatcggaatctatgcggcggcagcagttgtgcttgtcgtggtggcctgccagatgtataagaggcggcagatcgagacggcgggcgactgggtcagcatcgggatcatcaagccggtattccgctggggagcggcaatctgcggaggtctggtcgtcggtgtcacggtcatatccatgctcacggatctgccgcagctgcgcaaatatccgtggctgctgctctgcagtgtggtgatgggtttcctctttttctttggagcagagatgctgctggaaaagaatttcagggtatttcgcagaaaacgcgtgctggagtgggcggcgactgccgtgatcacagtggtgtttgtatccctgtttgaaatggatgcattcggtctggagcgctatgtgccggaggtggcggatgtggagacggcgttcgtctatctggattatccggtgcaggtgaaaggagaagaacttgcgacactgacggagctgcagcgccagattattgcaaataaggatgcctatcaggaggtagaacgtaccggttcgggattttattatacaacgttcctgtattatatgcaggatggttccaaggtggagcggcggtatgcacttccactgcctgaggcggatgggggtgctgacagtacaccggcagagcagatccttgcgtgggagagcgagccggagaatctggagcgtgagatttttggtatcggaaattcagagtgccggtttacctctggatatatggatctgtatacttctacggggcttaacaatacgcacatgttttccgagaaggagattgagcagatcttaaaggccatccgggcggatatcgaggatggaaatctggcgaagtattatcagtattgcgagcagccggaagacacgtactacagcaacattgaactggaatattatagtacaggcaggtatgttgacaactggatgtattattatgactatcacaacagtttagagaagctggaaggaaaagctgtggacgggcaggagatgacagcgggcggcaatctgtatctgacgttcggaccggactgcgtgcatatcgtagagacgcttgagaaacttggcatcacaaatgacgagtggaagctgatgacgaaccaagacatgatgcagtagaactacagcaggaagagaaattgccgcaataagcatattgtgctttgtgttgataagtaatatggtttagaaacatacttggggatttcatgtggaaatgcaggtggaaattcgtttgagaaaaatgtgagcatttcttccggctgaatgtttgcatcggattccgtgtctcttccacgtttggacaatccgacgggtgtatgtccgacacaccggagacaatgggcggactttctggtgtccctaatggcacctcttcacagacaatataaaaccgcgcgaaccgaactcgccggcatctgctattgaaaatagggcagatgccgactcagacagcggcttcgcgcggttatgttttgttcagaggtgccataagggacacacaaaaaagtcctacaaattgtctccgggatgcggacatgacccgcggagtgctccaaacttggaaagacacggatcatcgaagatgcaaacattcggttggttagaaatgccacatttgttgaaccgaatttccatttgcattttcatctgaaatcccaagggctggttttctaataatattacgtatcccacaaagaggtctatgcttattgcggcagttcctcttgcctgcctttgttaaactgctttacaagtcgggacagatattgtaaaatcaagcggtcaggattatgatagggacaggtgaagtctgcctgtcagtaagaagatggatgatactgttttttatagaaaggaaaggtcagatagatgagtaaacccgtagtagcggttgtagggcgtccgaatgttggaaaatccacactgttcaacgcacttgcaggagagcgaatttcaattgtaaaggatacgccgggagtgacaagagaccgtatctatgcggacgtcaactggctggattatcattttacgatgatcgataccggcggtattgagccggacagcagagatgtcattctctcgcagatgagagagcaggcggagattgccattgcgacggcggacgtgattattttcctcacggatgtcagacagggactgcaggattcggattccaaggtggcagatatgctcagacgctccggcaagccggtcgtgcttgtggtcaacaaagtggacagctttgagaagttcatgccggatgtgtatgagttctacaatctcggcatcggcgatccgttcccgatctcggcggcatccatgctgggacttggagatatgctggatgaagtggtcaaacacttcccggactatgcgaaggacgaggaggaggacgagcgcccgaaggttgcgatcatcggtaagccgaatgtcggcaagtcctccctcattaacaagctggcacaggaggaccgtgtgattgtctccgacattgcgggaacaacacgcgatgcgattgataccgacattacctacgacggaaaagaatatgtctttattgatactgcaggtcttagacggaagaataagattaaggaagagatcgagcgctacagcatcatccgtgcggtgacagcggtggagcgggcggatgtctgcatcatcgtgatcgatgcgacggagggcgtcacggagcaggatgccaagattgccggaatcgcacacgagcgcggaaaaggaattatcatcgcggtcaacaagtgggatgcgatcgagaaggatgacaagacgatctaccgtcacacggagaagatccgtcagattttaagctttatgccgtatgccgagattatttttatctccgcaaaatcaggacagcgcttaaataagatttttgagctgattgatgtggttattgcgaacaatagcatgcgtgtggcgaccggtgtcttaaacgagatcgtgacagaggcagttgccatgcagcagccgccgtcagacaagggaaaacgtctgcgcatctactacacgacgcaggttgcggtaaagccgccgaccttcgtgattttcgtcaacgataaggaattgatgcatttttcctacaccaggtatctggagaaccgtatccgtgagacgttcggtttccgcggaacggcactgaaattcattattcgggagagaaaggaagagcagtgatgataggagcaagggttattgcattgggaatcgggtatctgtttggactgtttcagacggggtatctctacggaaaaagccaggggattgatatccgcaatgagggaagcggcaacgcggggacgacaaattcactgcgcgtgcttggaatcaaggcgggactgatcacgtttgcgggagatctgtgcaaggcaattctggcggttcttctggtgaaggttctgttccggaacgcttacccggacgcagtcaggattctggaactgtatgccggcttcggagctgtgctcggacataattttccgttttacctcaagttcaagggtggaaagggaatcgcctgcacgtcgggcatgattctcgctgtgtgcccgatggcggcaccggtctgtctggtcttattcatcggttccatcgcgatcacaagatatgtgtcccttggatcgattctggtggtgacgagttatctggtgcaggtattgatcttcggacatatgggatatctgcatatcgatgccgcatatctcccggagttctatgtggtgagcgcctgctttacggcgatggcgctgtggcgtcacaggagtaacattggacgtctgctgcacggcacggagaataagttcacgttcaagaagaacaaacaggaggggaaataaaagatatggcaaaagtagcggtaatcggagcgggaagctgggggacggcgctcgcgaaagtgttgcacaccaacggcagccaggtgacggtgtggtcgattgtggaagcggagatcgcgatgctgcgcgaacggcatgagcatgtggataagcttccgggagtgaagcttccggaggatatggaatttaccacggatcttaaggcggcagtggaagataaggaatatctgattctggcggtaccgtctgtattcaccagaagcacggcaaaaagcatggcgccttttgtgaaggcgggacagatcattgtctgtgtggcaaagggcattgaagaaaatacgctgatgacgctctccgatattgtagaagaggaagtacctgcggcggaggttgccgtgatgtgcggaccgagccacgccgaggaggttggcgtcggactgccgacgaccgttgttgccggagcaaagaagcgcaaggtggcagagggcgtgcaggatattttcatgaatgaggtgttccgcgtgtacacaagcccggatgtgctcggcatggaactgggaggttccctgaagaacgtcattgcactggcagccggtatggcggacggactcggctacggggacaacaccaaagcggcgttaatcacgcgcggaatcatggaaatgtcgcgtcttgccatcaagatgggggcaaaggcggagacactgagcggtctgaccggaatcggagatctgatcgtgacatgtgagagcagacacagcagaaaccgcaaagccggaatgctgatcgggcagggctataccatgaagcaggcgatggatgaggtcaagatggtggtcgagggcgtgtattccgccaaggcggcgatcgcgcttgcaaaaaaatacggggtcgatatgccgatcatcgaggaagtcaactgtgtgctttttgaggataagccggcaaaagaagcagtgcgggaactgatgatgcgcgaccggcgtgcagagcatagtgccctggagtgggaagcatagaaatgcgacatggcaccccggagtggggagcatagaaatgcgacatggcgccccggagtgggaaacataaagaaatcgacataacaggaggaacatacatgccacagatcaggattaaatattttacggatgcgattgaacgtctgacctatattgacggaaagtcggactggatcgatcttcgggcgtctgaggaagtgacactgaaagcgggggagttctgtctgattccactcggcgttgccatggagcttccggagggctatgaggcgcatgtggtaccgagaagctccactttcaaaaattacggaatcatccagacgaacagctgcggcattatcgatggcacctactgcggggatgacgatatgtggcggatgccggtctatgcggtgcgcgacacggtgattcacgtcaatgaccgcatctgccagttccgcatttttgaaaatcagccgaagatcacgtttgacgaggtggagagcctcggcaacaaaaaccgcggcggattcggaagcactggaaaacagtaatgcgttcgtcaaagtgcttactttttgatggaaaacctgtcggtttgacgaaagaatagaaaaaacaaccaaaacactgtgacattctacaagaaaagcaaaaattctttgtgtaggcggtctatggtattttggctgttttttttgtatagtaagagtagttaaaaacgaacaaattttaggaggtatcgtaccaatggcaagtttatcattgaaaaacgtttgcaaagtatatccgaacggctttgaggctgttaaggatttcaaccttgaagtagaggatcaggagttcattatcttcgtaggaccttccggatgtggtaagtctactacacttcgtatgatcgcaggtcttgaggagatctcctccggtgagttctacatcgacggaaagctcatgaacgacgtagagccgaaggatcgtgatatcgcaatggtattccagaactacgctctgtatccgcatatgaccgtattcgacaacatggcattcggtcttaagttaagaaaagttccgaaggatgagatcaagagaaaagttgaggaggctgcaaagatccttgaccttgagaagttattagaccgtaagccgaaggctctctccggtggacagagacagcgtgttgccatgggacgtgccatcgtacgtaacccgaaggtattcctgatggatgagccgctctccaacctggatgcaaagcttcgtgtacagatgcgttccgagatcgcttccttacataacagattaaaagcaaccatcatctacgtaacacatgatcagaccgaggctatgacacttggtaccagaatcgtcgtattaaaggacggcgttatcatgcaggtagattccccgcagaagttatacaacgagccgaataacttattcgtagcaggattcatcggatctccgcagatgaacttcgtagatgctgtatgcaaggttgagggtgagaaagtaagcctttccttcgagaacacaacagttgttcttcctcctgcaaaagctaagaagttagctgacggcggatacaacggcaagactgttgttatgggtatcagaccggaagatatcggtgattccgagatcgagatcgaggctcataaggatgctgcattcgagacagatgtaacaggatatgagttattaggttctgaggtactgttatacttcaaagttgcaggcgcaagcatgactgcaaaggttgattccagaacaactgcacgtatgggcgaccacatcaagatggcaattgatccggagaagattcacgtattcgacaaagaaacagaattgacaattaccaactaatccgttagaattgaataggacttaaaagtaaaactgggtgcacatgttgtacccagtttttattaacgtatggaacacatgaggcatgtcaatgtacagtaatatttgacaggaaaggcgagacacatgatttcgaatcacaagatacaggcagcattagatgagataaaagagatttccaagattgatctggcactatatacggataagggaaagcaggtggcagcgacgtttgaaacggaaggggatatggagtacgctgtgaattcttttgcgggttccatggcggagagccagatgctgtccggatgtcatttctttaaggtgtatgtggacggggaactggaatatgtccttttgaccaaatcttctgcggaggacgcgtacatggtcggaagactggcggtctgccagatccggacgcttgtgtctgcttacatggagcagtttgaccggaacaacttcatgcagaatatcctgctcggcaatatgcttgtggtagatatgtacaacaaggcgcagaagcttcacatcgaacaggcggagcgcgtggtatttgtgatcgagctggaagggaagaaggacgccacagcgatcgaactggtcaagaatctgttcgcggcgaagaccagggattttgtgactgaggtggacgagcagagcattgtgctcatcaaagacaccagagagatgggagaggacgaggatctggtgtccctggcgtcaatgatcgtggacaatatgcatgcggaggcgatggtacgcgtccgggtcggctacggcaaccgtgtgaacaacctgcaggatattgcgaaatcctaccaggaggcaaagatggcgcttgaggtgggaaaaatcttctacgcggaaaaagagacgatcgcgtaccgttatctgggtattggcagactgatctatcagctcccgatgtctctgtgcgagatgtttattcatgaggtattcggggatgaaattccggatgtgttcaacgaggagacgacgacaacgatccagaaattctttgagaacaatctgaatatctctgaaacggcaagacagctttacgtgcacaggaacacgttggtgtaccgtctggagcgcctggagaaggtcatcggacttgatatccgcaagtttgatgatgcgatgacattcaagattgcaatgatggtcatttcccacatgcagtatgtcaagaatagtgaaaatgcactaaattagttgaaaaaatatatgctatatgttaaaattaaacaaaagacagcataagggagtggaagagttatggctggctatgtttacacgaatgagaactgtattgggtgcaaccggtgcatttcggtctgtcccgttctgacagcgaatcaggctgtcgtggtggacgggaagccgcgcattgaggtcaaccatgcacagtgcatcaactgtggtgcatgctttgatgcctgcgaacatcaggcgagggaatatgccgatgatacggagcagttttttgcggatctgcagagaggcgaatccatttcactgcttctggcgccggcatttcttgcgaattatcccagagagtatgagcagattttaggcggcttaagacagatgggggcaaagcggatcatcagtgtcagctttggcgccgacattacgacctgggcgtatatcaattatattacgaagaatcagtttacgggcgggatctcgcagccgtgtcctgcggtggtcaactacatcgagatgtatgcaccggaactgcttccgaagctgatgccggtacacagcccgatgatgtgtgcggcaatctacgcgaagaagtatttacatatcacggacaagcttgcgttcatcagtccgtgcattgcgaagaagaacgagatttccgatccggatacagacggctatgtttcttataatgtgacattcgatcatctgatggattactgcaggaagcaccggatcagtggaccgggggtcagcgatgagatcgaatacggtctcggctcgatctatccgatgccgggaggactgaaggagaatgtctactggttctgcggagaggatgtatttatccggcagattgagggagagcgccatgtctatgaattcctggatgcctatcgcaagcgtgtcgcagagcacaaggagctgccgtttatggtcgatgcgctgaactgtgcgatgggatgcatctacggtacgggcgttgagccggagaagactgccggggatgatgtgctctacgagctgcataagatccgggagaagagcaagaaggtcaagggaccgtgggcgagatcggcgacgtcgaagcagcggctggcacagctgaaccgtcagtttgcgcagcttgaaccggcggattttacgcgccggtataccgaccggtcgaaggggaatgagatccgcgtgccggagggccaggagttagaagcagtatacagccgtctgaacaagcagacggcgatggatcgtgcgatcgactgcagcgcctgcggttataagacctgccgggatatggcgacagcgatctacaacgggtgcaacagtgagaattcctgtattcattttatcaagaacgaggcggaggaaagagggcgtgcggcacaggcggctgcggaggaaagccagcaggcgaatgtggagatccagcgcagaagcgatctgattgcaggaattatcgagggactgaattccgattttcaggaactggattccgccatcgggcagatggctgccgggaatagcagcaatgcgagcgagagcacggcgattacggatgcgatgaccggcgtgaccggattctgccaggagatgcggcagtcgtttgaggcgatcacggagcttttggataagcttgagaacaacaacaacgacatcacgaagattgccaaccagaccaatctgctctcactgaacgcttccatcgaggctgcccgtgccggtgcggcaggcagaggatttgcggtggtggcggaggagatcaagaatctctcggagaacagcagagcaaccgcaaacgacagcaacgataacaagaatgagatcagtcaggcgatcggaaagctgttggaggagtcggatcatctgacagagattatccgggaagtggatgagcggatgaccaatctggcggcaagcaccgaggagatcgccgcatccacagattcggtgaaggagatttcctctgatctgaaggataaggcagccgagctgatgaacatgtaagatacaacagaaaagcaaatgataatacgcggacaaagaaagcaatcggattcttttccgcgtatttcgtctgtttgcacaaaaatagaaaatttttacaaaacatacgttctgttgcttgcacgggttttcccagtatgttatattatccagaggaatgtcaaggaaaggaagaagaacatggcaaagaaagagacttatgacgagagtagtatttccgttctggaaggactcgaagccgtaaggaagagacccggaatgtacatcggaagcgtgtccagaaagggtctgaatcatcttatttacgagattgtggacaacgcagtggacgagcatctggcgggtgcctgcgataccatatatgtcacattggaggcggatggctcctgtacagtggaagataacggacgaggcgtgccggtcggcatgcacgcgaagggcgtgtcggcagcgcgaattgtgtacacgacgctgcatgcgggcggcaagtttgacgattccgcatacaagaccagcggcggactgcacggagtgggttcctcggtcgtgaatgcactgtccacctatatggacgtcgagatcagcagagacggctacattcatcacgaccgctatgagcgcggtgtgccggtggtggagcttgagaacggactgcttccgaagatcggtaagacgaagaagactggaacgaaggtcaatttcctgccggacccggagattttcgagaagacgcgtttcaaggaggacgaggtcaagagccgtatgcatgagacggcatatttaaacccggagcttacgatcatctatgaggaccggagaggggaggagaccgagcatatcgtctaccacgagccggaaggcatcaaggggtttgtgaaggatctcaacaagagcacggaagttctgcatgacgtcgtgtattttaagggagagactgagggcattaccgtcgaggcggcgttccagtacacgaacgaatttcatgagaatattctgggcttctgtaataatattttcaacgcggagggcggaacacacatcaccggttttaagacggtgtttacgactgttattaatgcctatgcgagagagcttggcatcttaaaggataaggacgccaattttaccggtgcggacgtgcgcaacggcatgacggcagtcgtctccatcaagcacccggatccgcgcttcgagggacagacgaagacgaagctggataaccaggacgcgtcgcgggcgacggcgaaggtgaccggcgacgagatccagctctattttgacaagaacctggaagtgcttaagaccgtcatttcctgtgcggaaaaggcggcgaagatccgcaagaccgaagagaaagcgaagacaaatcttctgacaaagcagaagttctcctttgactccaacggcaagcttgcgaactgcgagagccgggacgcatcgatctgcgagatttttatcgtcgagggagattctgcgggaggttccgcgaagacagcgagagaccgcagctttcaggcgattctgccgatccgcggtaagatcttaaacgtggagaaggcgagcatcgataagattttagccaacgcggagattaagacgatgatcaatgcgttcggctgcggattttccgagggctacggcaatgatttcgatattacgaagctccgctatgacaagattatcatcatggcggatgccgacgtcgacggagcgcatatttccacgctgcttttgacgttattctaccggttcatgccggagttaatctatgagggacatgtctatgtggcaatgccgccgctttacaaggcgattccaagccgcggcgaggaagagtacctctacgatgatgaggcgctggagcgctatagacggagccacaagggcagttttacgctgcagcggtataaaggtctcggcgagatggacgcggagcagctctgggagacgacgctcgatccgaagagacggctgttaaagcggattgagatcgaggacggccgtatggcgtccgacatcacggaacttctgatgggcaatgacgtgccgccgcgcaagacctttatctatgagcatgcgacggatgcgaccgtggacgcatgacagatgcgataccgtgcggcaggatcatgcgcgggatgagagagccgcaggaagaagcggcaggaaatgaggattaccatgaaacaggaagaacagattatccgcaccgagtattcggagctgatgcagaaatcctatatcgactatgcaatgagcgtgattatctcacgtgcactgccggatatcagggatgggttaaagccggtacagaggcggacactttatgatatgtatgaactcggcatccgctatgacaagccgtaccgtaagagtgcgcgtattgtcggggataccatgggtaagtatcacccgcacggagacagttcgatctacggtgcgttggtggtgctggcacaggattttaaaatgggacagacgctggtggacggacacggcaacttcggctccatcgagggagacggagcggctgccatgcgttacacggaggcgagacttcagaagctgacgcaggaggcgttcttagcagaccttgacaaggatgtcgtggattttgtgccgaactttgacgagacggagaaagagccggaggttctgccggtaaaggtgccgaatcttctgatcaacggtgcggagggaattgcggttggcatgacgacgagcattccgacgcacaatttcggcgaggtcattgacggtgtgattgcctatatgaagaatccggacatcaacaccgagcagatgatgcagtatatcccgggaccggattttccgaccggcggtgtgatcgccaacaaggacgagttgacagccatctactccacaggcgtggggaagatcaagatccgcggaaaagtggaggttgagcaggtcaaaggcggaaaggaacgcctggtaattaccgagattccgtatacgatgatcggtgcaaatatcggaaagttcttaaacgatgtctacagcctcgtggagacgaagaagacgaatgacattgtggatatcacaaaccagtcctccaaggagggcatccgcattgtcatcgagctgcgcaagggagcggacgctgccaatctggagaatctattatataagaagaccaagcttgaggacacgttcggtgtcaatatgcttgcggtggtagacggaagaccggagacgatgggaattgtgccgatcatacgtcatcatgtgaatttccagtatgagctggcaaagagaaagtatacaacgctgcttgccaaggagctggagaagaaggaagtgcaggagggattgatccacgcctgcgatgtgatcgatcttatcatcgagatcctgcgcggcagtgcgaacgtcaagatggcgagagcctgtctgaccgagggaatcatcgaggggattgcctttaagtcggcgcagtcccaaaaggacgcgcagagcctgcgttttacggagcgccaggcggatgccatcttagagatgcgtctgtacaagctgatcggactcgagatcgaggcgctgatgaaagagcacgagaagacgcttgccaatattgcggagtacaatgagatcttaagcaaccgtgcggcgatggcaaaggtgattatccgcgagctggaagcttacaaaaaggagtatggcagaccgcggcgcactgtcattgacaatctcaaagaggcggttgtcgaggagaagaagattgaggagatggacgtggtattcctgatggatcgctttggctacgcgaagacgatcgacgtggcggcgtatgaacgcaaccgcgaggcggccgatgcggagaaccgctatgtgctgacctgtaagaataccgataagatctgcatttttacgaacaagggacagatgcatctgctcaaggtgctggatctgccattcggcaagttccgcgacaagggaacgccgattgacaatctgagcaattataacagcagtgaggagaactttgtctatatcacgaatctgggagcgatctgcaaccacaggctgatctttggcacgaagacggcgatgcttaagattgtggacggaagcgagtttgacgttgcaaagcgcacgaccgcggcgacgaagcttaccgacggggacgaggtgcttttcgtgcatccggttgccgggaatgagacgatcgtcatgcagtccgagcgcgatttcttccttcggattgcggtggataccattccggagaagaaaaagggtgcggtcggcgtccgcggcatgcggcttgcggacggagatgcgcttactgcgattcatctgctcggcgagggtgagagcgcccagacggaggtaaaaggaaagcctgtgatgttaaaccggctgcatgtggcgggccgcgacacgaaaggaacgaagaaataacgatgataaaagctgtattatttgatctggacggaacgatcatcaattccgaggagggcatcacaaagtgcgtgcaatacgcactgcgcgcctacgggatcgatgagccggaccgcacgaagctgcgctgctttatcggaccgcccttagatccggtatttcgcgaaaagtatggcatgacggaagcggaagcgtggcagtctgtggaaaagtacagagagcggtttgacgtaaagggaatcttcgagtgcagcctctacgacggcgtcagggaagcgatcgcgcgcttcaaggagcatggttatctgcttgcgcttgcgtcttcaaagccagagacagcgtgcagaagaatattagagcactttgatctgctgggatattttgatgaggtggtaggttccacgctggacggctcgatcagtacgaaggcggaagtgctcgaggaactggggcgccgcatggcgggcagccatatcgggaaaaacgaactgtgcctgatcggggacacgaagtatgacgctgccggagcaaaggcgttcggaatccgctgtatcggtgtcagctatggcttcggtaccagggaagaactgctcgccgcaggtgcggaggcggtcttcgaccgcatcgaagaggtggagacatacattgagaatgacgcagcgggagagggagaggcagagtgaagacgacaggtgcttataaaatctggagaatcatatatccgatcggtatctattatgtggtgtcatcgcttgcctacttttttctgacgctgctgctcggcgcgggggaggaatcctacatgctgcggcagatgctctgcgcggctgccacgattccgttcgtctggatgcattacgggcaggatcgcgctgcgcgggagactgtctatggcaggcgcggcatcagaccggacgcaaggtttttctgcactgtggcaggctcactgcttgcaggagcatctcttggcatggctgtcaacaacgtgattgccatgacgccgctcattgaggcgtccgcgggctttcaaagcgcgaatcaggcgttttttgccggcggggttgtgtttgaactgctcggctcctgcctcgtgattccgctggcggaggagcttttgtaccgtggtgtcgtggagagaagactatccctgctgtgcggcagtgcgccggcaatcgtgctctcggcggttattttcggcgtgatgcactggaacgtggtacagtttttgtatgcgggcattttaggtctgctgctcgcgtggctgctggagagaaccggctttttgtatgcgcccgttctggcgcatatcggggcgaatgtgatggcggttgtgcgcagcgagactggctggctggactttgcctaccagcccacagcggcaggtgttgcagtgacggtgctgctgtttgcggtggcagcgtttgcggttctgctggtgaaaaagggcggagtgcggcaggaagaggagaaaacgtccgctgcctgaaaccttagcagtatctgtagaggtgcagttattgactgttatagcttcctgtggtatgttaaatgacgtgaatggcgggatccccggtccatttagcatcgcaggaaggagagtgacagtttcatggacgatagtgcggacagtgacagcgatacacagatatgcaggcttttaaaaagagaatacggctgctccatgcagtgttatgaataggtaaaggtatggcttaccggaggtcttttttggacaccggaaggtcatacctttttgtgcgtaaatgacacaacacgtaacaggcagcaggagggcgtatcacaggacgccggaaacagaaaggagcagacatgttgcagcccatattcttattgatggttttgatttttttgaatgccgtatttgcaagcgcggagattgcggtaatctcgatgagtgatttaaaactccgacagctctgcgaggcgggagacaggcgtgccggaaagctggaggcgctcataaagcagccggcaaaattccttgccacgatccaggtggcgatcacgctcgccggatttttacagagtgcgtttgccgcggaaaactttgcacagccgttggtgacgcttttgaggggcaccggaataccggttgcagaggaggcattaaaatccgcgtgcatcgtggtgattacattgattttagcgtattttaatctggtcttcggggaacttgtgccgaagcgggtggcgatgaaaaaggcggaggagctggcgcttaaaatggcaggaatgctctccctggtggcgaagatctttgcaccgctggtgtggcttcttaccgcatcgaccaatttctggttaagacggtttggcattgacccggaggaggaagaggagacggtgtcggaggaggaaatccggctgctgctcgccgagggaagagagcagggaaccattccgaccgaggagacagagatgatacagaacgtgttcgggtttgatgatattgcggtcggaacgatctgcacgcaccgcagggagatggtatctctgtccacggaggaggatgaagccgtctgggatcggattctggcggagagcgtacatacctattatccgatctttgcggggagaagcgaggatgtcgtgggaatcctcgatggaaaagcgtatttccgcatgaaagaccacacgcgtgacaaagtgatgcagtgcgcggtacaaaaaccgatgctggcagcggattccatgaaggcaaaccggctttttgagcagatgaaacagcagcagaattattttgcggttgtgacagacgcctacggcggggttaccggaatcgtgacgctgtgcgacatcatggagtatctggtgggagatctggagaatacggttaccgcataaaatggtgttataattcagatacaatttaagaaaaggcagaaaaagagcccggaaaaagttttgcatgcaaaattttttccgggcttttatatgttgaattgtgtgtgagaaaattatttatacaaaaaataatgaataatatctgataataataaaaaataaacattatatacaaataatcagacaattataagaataaactggtagacaaacaaatgagaaagttgtatattaggatataacaaattcggtaaagacaactgtccgtgcagtaaagacagctgatcggaatacagaatgcagaaaggaagctgattatgaaagagcagaccacttataagaaggacgccctcaaccgtttctcggtatcggatgcggggaagcaggcagccggaatgtacgatccgggttacgagcacgataactgtggtatcggttcggttgtcaacattaagggaatcaagacacacgagactgtggagaatgcgttaaagatcgttgagaacttaaagcacagagcaggcaaggatgcggagggaaagaccggtgacggtgtcggtattctgctgcagatatcccacaagtttttttccaaggcggcaaaacagcttggaatcgaactcggtgaggagagagactatggtgtcggcatgttctttttcccgcaggacgagttaaagcgcaaccgtgccaagaagatgttcgaggtcattgtcggcaaggagggaatggagttcctcggctggcgtgaagttccgaccgatccgacgaagctgggacagaaagcggtggactgcatgccgtatatcatgcagggttttgtgaagcgtccggcggatgtggagaagggactggcgtttgaccgcaagctgtatgtggcgcgaagagtcttcgagcagtccaacgacgatacctatgtggtatccctttccagccgtacgatcgtctataagggaatgtttcttgtggagcagcttcgtctgttttttgcggatttacaggataaggattacgagtcggcgattgcaaccgtgcattcccgtttctccacgaacacgaacccgagctgggagagagcgcacccgaaccgttttatcgtacataacggtgagatcaatacgatcaagggcaacgccgataagatgctcgcccgtgaggagacgatggagtccgagcacttaaaaggcgaacttcagaaagtgcttccggtcatcaacagtgagggatcggattccgcgatgctggacaatacgctggagttcctcgtgatgagtggtatggagcttccgctcgcagtcatgatcatgatcccggagccgtgggcaaacaacaatatcatgtcgcagaagaaaaaggatttttaccagtattacgcgacgatgatggagccgtgggacggaccggcatccatcctcttttccgatggcgatatgatgggagccgtgcttgaccgcaatggtctgcgtccttcccgttactatattacggatgatgattatctgatcctctcctccgaggtcggcgtgctggacatcgacccgacgaagattgtggtaaaggagcgtctgcgtccgggcaagatgctgctcgtggataccgtcaagggaagagtcatcgatgacgacgaactcaaggagacttacgcgaacaagcagccatatggtgagtggcttgaccgcaacctcttaaaactcgaggatttaaagatcccgaatgagcgtgtgccggagtataccaaggaagagcgccagcgcatgcagaaggcattcggttatacctacgaatctctgcgcgaggcgatcctgccgatggcgaaaaacggtggcgagggtacatccgccatgggtattgacacaccgcttgcagcgcttgcgagtgaccatcagccgctgtttaattacttcaaacagctgtttgcgcaggtgaccaacccgccgatcgactcgatccgtgagaaagtcgtgacctctacgaccgtctacatcggcgaggacggcaacctcttggaggagcgggcggagaactgtaaggtattgaaggtcaacaacccgattctgaccaacaccgacctgatgaagatcaaggcgatgaaggtcgacggattcaaggtagaagtactgccgattatctactataagaatacaagcttggagaaggcgatcgagcgtctgtttgtggaggcggatcgtgcgtaccgtgagggagcgaacattctgatcctctccgaccgcggcatcgacgagaaccatgtgccgatcccgtcactgctcgctgtatcagcactgcagcagcatctggtaaagacgaaaaagagaacggcggttgccatgatcttagagtccggagagcctcgtgaggtacaccattttgcgacgctcctcggctacggagcctgtgcgatcaacccgtatctggcacaggataccgtaaaacagctggtggacgagcatatgctggacaaagattattatgcggcggttcaggattacaatgcagcgattttaaacggcatcgtcaagatcgcatccaagatgggaatctcgacgatccagtcctacgagggttccaagatcttcgaggcgatcggtatcaataaggatgtgattgacaagtatttcacgaatacggtcagcccgatcggcggcattacgctggaggatattgcggatgacgtcaatgagcttcactcggcggcgtacgatccgctgggattagagacggatctcacattggacagcagaggacgccacaagatgagaagcggcgcagatccgcatctctacaatccggcgacgattcatctgcttcaggaggcgacaaagcgcggcgactacgaactctttaaacagtacacagagcttgtgaataaagaagagagagagatcacgctccgcggtctgatggatttcaattacccgaaaaagggcgtgccgctcgaggaggtcgagagtgtcgattccatcgtgacgcgttttaagacgggggcaatgtcctacggttccatctccaaggaggcgcacgagacgttggcgatcgccatgaaccgtctgcacggcaagtccaactccggcgaaggaggagaggatgcagaccgtcttgcgagcaagaacagcccggtcaaccgttgctctgcgatcaagcaggtggcgagcggacgtttcggtgtgaccagtgagtatctggtgagcgcgcaggagattcagatcaagatggcacagggcgcaaagccgggcgagggcggacacctgccgggcaagaaggtctatccgtggattgcaaagaccagactttccacaccgggtgtatcattgatctccccgccgccgcatcatgacatctactcgatcgaggatctggagcagttgatcttcgacttaaagaatgcgaaccgtgatgcgcgcatcaccgtgaaactggtatccgaggcgggagtcggtacggtcgcagccggcgttgcaaaggcaggcgcacaggttgtcctgatctccggctatgacggcggtaccggtgcggctccgtccagctcgatccacaatgcgggacttccgtgggagcttggtcttgcggagacacatcagacattgattatgaacggactgcgcaacaaagtacgcattgagacggacggcaaactgatgagcggccgcgatgtcgctacggcagcgctgctcggagcggaggagttcggatttgccacagcgccgcttgtgaccttaggctgcgtgatgatgcgcgtctgtaacctggatacctgtccggcaggtattgcgacacagaacccggagcttcggaagcgttttgccggcaagccggaatatgtggagaattttatgcgctttatcgcacaggatctgcgggagtatatggcaaagctcggatgccgcacgatcgacgagatggtcggcagaagcgatctgcttaaggtgcgcgaggatctttcgggacgcgaccgcgagatcgatctctccaatcttttgaacaacccgtttgcgggaccgaaggagaaagtaacctttgacccgaagcatgtctatgattttgaactggagaagtccaaggatgtgaccgtgctcttaaaacagttaaagggtgcgttagagcagaagcagcgcagaagcattgatgtggaggtgacgaacaccgaccgttcctttggtacgattttcggttcggagatcacgaagaagtacggcggagagggactgccggaggataccttcattgtaaaatgcaacggtgccggcggacagagtttcggagcttttatcccgaagggactgacgttagagctggtcggcgattccaacgattactttggaaaaggattatccggcggcaagcttgtcgtctatgcaccggcgggcgtgaagtatgagaaggatgagaatatcatcatcggtaatgtggcgctctacggagcaaccagcggaaaagcgtttatcagcggcgtcgcaggcgagcgtttctgcgtgcgcaactcgggagcttccgcagtcgtggagggtgtcggagaccacggatgtgaatatatgacgggaggccgtgtcgtcgtgctcggcaagaccggcaagaattttgctgccggcatgagcggcggtattgcttatgtgctcgatgaggacaatgacctctacacaagaatgaataaggaaatggtattcagccaggagatttccaacaaatatgatgtcatggaattaaaggacatgatcaaggaacatgtggcgctgaccaactcggaaaagggcaagaagatcctggataatttcagcgagtatctgccgaagttcaagaaagtcataccgtatgactataaccgtatgcttatggcgattgttcagatggaggagaaaggtctttcttccgaacaggcacagattgaggctttttatgcaaatacgcgtggatagtgtgtgagcaggtgtcgtttgacatgtgtgactcatgcattttcgagaaaggaaagaattatgggaaaaccaacaggatttatggaatatgacagagaagatgcccgcgccattgagccgaaggagcggatcaaaaattttaatgagttccacattcctctgtccaaagagagacaacagattcagggcgcgcgctgcatgaactgcggcgtgccgttctgccaggcgggaatgaacatcatggggatgacctcgggatgcccgctgcacaacctggttccggagtggaatgatcttgtatacacggggaactgggagcaggcatacaaccgcctgaagaagaccaacaatttcccggagtttacctcccgggtatgtccggcactctgcgaggctgcctgcacctgcgggcactgggaagatccggtgacctgcaaggcgaacgagcacggaattatcgagaatgcgtatgagcagggttatgcggcggcaaagcctccgaaagtgcgcaccggcaagaagatcgcggtgatcggctccggtcctgcggggcttgcggcggcggatcagctcaacaagcgcgggcattctgtgacggtctatgagcgggacgacagagtcggcggacttctgatgtacggaattccgaatatgaagctggaaaaatgggtcatcgaccgcaaggttgccgtcatgaaggaggagggcatcacctttgtgaccggcaccaatgtcggaaaggatgtaaagtcctccaagctgttaaaggagtacgaccgtgtgattttagcgtgcggcgccaagaatccgagagacatcaaggcaccgggacgggacgccaagggaatctatttcgccgtggattttttaaaagcaacgacgaagagtctcctggattctgagctaaaagacggcagctatatctccgcaaaagggaaaaaagtggtcattatcggcggcggcgataccggaaatgactgcgtgggcacgtccatccgccacggctgcgcgagcgtgacacagcttgagatgatgccgcaggcaccggcaaagcgcgcggagaataatccgtggccggagtggccgaaggtgttaaagaccgattacggccaggaggaagcgattgcggtgttcgggcacgacccgcggatctatcagacgacggtgaaggaattcttaaaagacaagaacggcaatctttgcgggcttgtcactgtaaagctcgaaccgaagcgggatgagaagaccgggcgtgtgacgatgaccgaggttgcgggaagcgagcagaagatggaagcggatcttgtgctgatcgctgccggattcctcggcacggaaaaatatgtggcggacgcgttcggtgtggacttaaacggcagaaccaacgtcgcaacggcggagggcgcctatgagaccagcgtgaaaaatgtgttcgcggcgggcgatgtgcacagaggacagtcccttgtcgtctgggcgattcgcgagggacgcgaggtcgcgcgcgaggtcgatgagagcctgatgggctactcctaccttgaggtgcagtaatcgaatgataatcccccgtttgtaatccaacggattctgtgctaagatgagaaaaaagagtacgaatgaagaaaaggggagtacaaatgagccgcagaaggaaaaaagcaggggaaaaggcgcggacgatggcgggaagcgcagaagcggaaaagacggcagcgggaagcacaccggcagagcaggaggcagggagcacatcggcgaaagagacgttatcggcgagcatagagccggcggagagatcggaaaatgaggcggaggtctggcagaccggcgcgcgggtccggatcgcggatatggagccggattactcggatatcacagtgaagaatccgcgcatcggcaaggtcatgcgccttgaggaagaggtccagagacagagtgagatcgagaagctgcgcagcagacggatccggcaggagcaggaatatattgaccggatgagcctgtcggtggagaatcatctgcgcaataccaaggaagagcagcggtacaacgagcagttcgaggagcgcatccgcacggaagtgtaccggatgcacgggatcagtgaggacaagctgcaggggatgacggagtaccgcaatgcgtggtatcagggcacggcgtttgccatgtttttcctgtcgctcgtgctgatcgcgatctgcggcatactgcacgggttcgggtcggagatctgcatttttatggcattttatacggccattgagggggcattgctctccaacgggaggaagcagtcactgttttttacggtgctgacgaagggcgtgtatctgctgctgtttccggttatgctcgtgacgtttacctgctacgaacttggttttgaggaatatgcgcttctggtaccggttttcgccgtggcaggtgttgtggtgctcatgatcggagcactgtcctacttcctgtatgatccgtaccggatggaccggaggaaccgcaagaaggcgaaccgctatatcgtagagatcgagaaggcagcgctaaaggaagtgcgtctgaaggaaagggcgttcgcgaagcaggagaaaaagcaggcgaagtttaccagaaaggaagaggcgagagcgcagaagaaggcagagcgggacgagcgccgcagacagcggaaggaggcgcgggcagaaaggcatgcacgctggcgcgcatggtggagcgagaagctggcgcggcttaagtttgtgaagaaagaatctgcggatgagacgcataagagtccggcgaatgcagatactacggaggaacattctgcggaaggagactctgtggagagggaatctgcggagagagattcggcagaagcagaatctgcagagagagaatctgcggaggaacattcgacagaaggagaagttgcaaagagagactaggcggagggaaattccgcggagaaaaacactgtgaaagaagcgtgtgaaaatgagacgactggggattgatctttcctattttttcacatatgaagatgagataccggacggggtgggattttcccactttggtccggtacatttattatggctgggcgtgtgcgcggggctcttactgctgttcctccattattataagcgatggggaggacggcgcaggcttttggcggagagaggaatcggcatttttctggtgggactggaagtgtaccggattgcggtgctggctctgatcgggaaaatgtcgctgtatcaactgccgcttcacctgtgcagcatggcagggtttttgtgctgtcttcacgcctttttcaaatgggactggctgggacaggttctctataccctgtgtctgccgggaaccgtgcttgcgcttttattcccggactgggtgcgctatccggcgattcattttattacgatacagggatttaccttccatgccgggattgtgctctacgtgatctgccagctgttgcagcacaacattatcccgcggcttgcggcgctgtggaaggtgatcgtatttcttctggtggttgtgccgccggtttacctgtttgacaaaaagtttcatgccaattacatgtttgtgaatgtgccttcgcccggatcgccgctggagtggctggcgtcgtttctggggaacccgggctatctggcaggctatgcggttctgatgcttttatgcatggtgctcatggacgccggttaccggctgttgcttgacaggaaaagctgcggaacgtagaataaaacgaaaaagagagaagcgctacggatattgcaggagaagaattgctgcgatggggtgcgcagaaatgaggagcatatggcagattttacattttcaacactgaaatacgagagaccggatttcacagaagtggaacagctttttgaaaaactggtaaaacaggtacaggaggcagcctcctatgagggattaaaggaactcttaaagaaggcagagcgcgtgcagaataagcttatgactgcgtgcacgattgcgtccatccgccatacattagatacgacggatacttattatgagaaggaagacgaatatatcaacaataccataccgaccgtgatgccgaagtttcttgcatttgatgcggcagtgatgaatagtccgtttcgcgatgacatcgagaaagagtacgggaaacagtattttgcacagaaggaactgaacaggaagactttctgtgaggcaaatattccgctgatgcagcaggaggcgaagctgacaaacgaatatcagaagatcatggcaacggcggcgatcgaatttgaagggcagacgcttaatctctatggtgtacagaagtattttgaacatgaggacagagaagtacggcgtgcggctgtgcgggcatattctgatttttaccacagcaatgagaagcggctggaggagatctgggaggaactcattaccatccgcaatcagatggggaagaacctcggctatgccaactttattccggtggggtacatgcagcagggacgcacggattatggggaaaaagaggtggcagcgttccgcgagcaggtgcgtacggaactcgtaccgctgtgtgaacagctctatgcggcgcaggcgaagcggattggtgtggatacattgatgttttatgatgagaagcgtgtatttccggatggaaatgccgttcctgcgggagatgatgattttatggtggaagaggcaaggaagatgtaccataagatcagcccggagactggagagttcattgattttatgattgagcacgaactgatggatttgaagaataagccgggaaaagctgctacgggatatatgacatttcttccggattatcaggcaccgtttgtgttctccaattttaatcagacaatctttgacatgcaggtgctgacacacgagctgggacatgcgtttgcaggatatatggcaatgcgcagccagccgattgcagagtactactcagagtctaccgacattgcggagattcattccatgtcgatggagcagttttcctatccgtatgcggaggcatttttcggaaaagatgcagataaattccgctttgcacatttgatggatgcgatcacatttgtgccgttcggtgtggcggtggatgagttccagcacatctgctacagcaatccggatctgacgccgaaggagcgcacggcggagtggaagaagctggaagagaagtatatgccgtggagaaaatacgacgcggatgatttctttgaccgcggtggtttctggtaccacaagctgcatatctatctctatccgttctattatatcaactatacgctgacgacgatgggagcgatggagttcaaaaagaaaaattatgagaaccacgagacagcatggcaggattacttaaatctctgcaaatgcggcggaagcatgagctatctggagacattgcgctatgcaaatctgtcgaatccgtttgcgccgggcagtgtggcacgtgcgatggaagtagcaaaacaggaactgatgaacagtccgtttatgagatagtatagaagcagtgttggatgagtgagaaacggaggtaagattgtaatatggaagaaatgttggaagtgatgaaaaaacagttgaaaatgcagaagcttatcagcgggctgctggcggtaatgctggtaattctgctcattgcgggtggattttttgtcaaccggatgagtcagatgacggcagcaatgagtgaggcggcagataaactgcagcaggtcgatgtggatggtatcaatgatgccatcggaacgacgcaggaaatgctcgagagtgccggagagctttccgatgcggtcgattccgtgacattaaaagtaaaagagttcaatgactggatgtcaggactttttggaaattagcaggcgttaataaaaacaaaccggcgaggcgagattgcggagcagggctaccgcgctccagccggcgattgcgctggtggaagagcagatgtccacggtggctttgacgccgtcgatctctgcggtgatgcagtggtcatcgcccgtccagcccggaacggagtgcatggttacctgcgtgatgtccggtcctgtcgtggcgagcgaggtggcgacggcgacgttgacgcggcgcggaaaggttgcgatcgcctccttggcgctgccggtaaagacagtcgtcttttcggtatcggttaaaaggtgttccgcccagaccggtgtattgcgaaaaccgcgggcgccggtgtgcgtctcgatgccggcggtctcgtcaagctttcccgcctgcgccattaaagtgatcgtctgtaagacgtcaaaaccaccgatcgcgccgtttgccagatggactttggcgcatcccctgcgggctgcgtccctgacctgcccgtaaaaggcagcgtcggcaaacgcaccgatcgagaggagaacgaggctgacgccgtgttcgagtacggtgcatgccatatcccggacagcttccacggacgctgcctccacaatatattccggctctaaggagagcagttctgcaagatcccgacaggatctgcagccggtttccgcagcggtcttatcgcgcgattcctgtgagcggctggtcacgccgacgagctcataatcttccagaaaaccatccttccaggcgtttgcgacaatgtttccgagaaaaccgcagcctacaataccaaatcttatcttcatcgtaaaaatcccttcgttatctgaatttattttgatcctttttcatgcttttcttgctgcccaccttttgacaaagttccctttttggcagaaaactcttttgttgcaggagtccgttttgtcccgggagttcctttttttgcaccgtttccctttttgcccggggtgtctttccggacgctgtagccgaatgtgccgagctttttcccgagaagaaaatactctccgtgcgagtaggtgatcagcccggtgtcgtttaagtggaatttgccggcttcatccatatacgcgtcatcgatggtgacagcgacgacgtccgcaaggatcagattgtggctgccgagcggcgtgatctggcgcacacggcattcgatattgacgggactctcggcaatgccgggaaccgatacctcacgggaggcaagcggcgtcagatgcatctccttgaacttgtcgacgtctctgccggagcgcacgccgcagtagtcggtggcacgtacaagcgcttcggttgtgagatttaccacgaactcaccggcggtctcaatcatgtggtaggagtagcgctccggacgaacggagatggagagcatcggcgggttcgtgcagacggtgcctgcccaggcaacggtaagaatgttcggtctgcctgcgagggcaggattgctgcattccggatcggatgcgccgggatactggcagcttaccatgacggcaggcagcggatagagcatgttgccgggtttgaaagcactttttcccataaaataaggactcccttctgtctgtgaaaaatatctgtgtctattgcatcagaatgtccatcagatatgcgtagacatcctcgttctgttttttccagttgttgcagatcgcctccgcctgttctttgtttttgacggtcagtgtcaggtcgattaagttggtatcgtggacgcggaactgacagcgcacggcatagtcctgattcggcgtcttgtaatagtctgcgatgatcgagttgacggtgcggagcgccattttatttttttcaaaataggcgatggtgtcatgctcgatcgcgtccgtgagcttgtcgcggaaaaagccgagcgtctcacgccccgcggcggtgatgtaatactgcgtgttgctgtgtgtggattccgtgcggatcagaccggagtctgcgagatcgtttaagacctgctgtacccggaaataatccgtgtattcctgctccagaaaaaagtcggagatctgcgtgttggtcagcggaaaatcgaccttatccagcatatttaaaatggtcagtttgtatatggtaaatggttcagccatgtgtttcctcgtttctataatatttgccctgccagagatcgcgctgtacaagttgcctgtttatcgtgtttaacacgcgctttttgtccgtgctccacagcggagcgaggagcaggcggcgcggtccatcgccggtcagacggtggatgaccatttccggtggaagaagggcaaggcagtctgcgataaggtcgcagtattcctccagcgtaaacagcggaaatggattggttttgtagtgcgttccaagatcggtaccctttaagacgtgaagcagctgcagctttacgccgaagaccggatgtgcggcaagatagcgcacggaagcgcgcatatcttcggttgtctcaccgggcagacctaagatcagatgtgttatgaccttgatgccccgcgcgtgaagcgcggataccgcctgctcatactgggcgagtgaaaaaccgctgcgtatcaaatgcagggtatgttcgtggatggtctgtaaaccgagctccacccagactggttttatggtatttaattctgccagcagatctaaaacctcaggcggcagacagtcacatctggtggcgatggagagcgccacaatgtcgggctgtgcgagagcttccgtgtaaagcgcacgaagaacaccgacgggagcgtaggtgttcgtgtatgcctgaaaataggcgatatatttgcggcagtttgttttttccagaaggagaagctttgcctgcgcaatctgttcagtgacagattgctgcggggaggcggcaaaatcaccacttcctccggcactgcagaagatgcaccctctggtatcgatgctgccgtcgcggttcgggcaggtcatgccgccgtttagagacaggcggtagaccttttcgccaaatgtctggcgtaaataagtattgagggaatagtaacgcgcgtcgttcatgatacgtccggttaacgcacgatgtgagagcggacggcttcacttaccacctgtgctacccggggatcaaaagcttccggcatgataaattcgtcgtttaactcctcatcggacacaagaccggcaatcgcctctgcggcggcaagcttcatctcttcggtaatctgtgttgcccgtccctcgagagcgcccttaaagatgcccgggaatgccacgacattgttgacctgattcgggaaatcactgcgtccggttccgacgattctggcacccgcagcctttgccacatccggcatgatctcaggaaccggattcgccatggcgaacaggatggagtcgtgattcatggaagcaaccatctccggggtaacgatgttcggtgcggagacacccacaaaaatatcagcaccctttaaggcgtcggcaagcgtgccgtgctgatcctcaaggttggtgacttcggtcattttctgctgcatccagtttaagttcgggtaatctttgccgatgatgccctcgcggtcacacatggtgacatggcgaaaaccgtaggtgagcagaagctttgtgatggcaacgcccgcggaaccggcaccgtttacgacgacgcggcagtcctcttttttcttgcctgtaacacgcagaccgttgataatgccggcaagcacaacgatggcggtgccgtgctggtcgtcatggaagaccggaatgtcgagcatttctttcaggcgctcctcaatctcaaagcagcgcggtgcggaaatatcttccagattgatgccgccgtatgcgggagcaatgttcttgatcgtggcaatgatctcctccgtgtcctgggtgtcgagacagatcggtacggcattgacatcgccgaattccttaaacagaacgcattttccctccatgacaggcatggcggcatatgcgccgatattgccgagaccgagaactgcacttccgtcggaaatgacggcgacggtgttggctttcatggtatatttgtaagcagcctccgggtctttggcgattaccttgcagggctcggcaacacctggcgtgtatgcgatggcgagatcttcgcgggagtttactttggattttgcgatggtctcaagctttccgttccatttttcgtgcataagaagtgccttctcggcaagtgtcattgtctgattctccatgatataatctcctgtatataaagtgtatttttatatagaaaccaatacgtaaatcataccattatcattttgacaaatcaaggaaattaggacttcctattttggaaaaagtgttgtataatacgcatattgtaaattcattttgtcaattcagacacgattcccaatacgattgagagcatagaggaaaatagcagattgataagaacaggagcgaatggatgagagaaaagtatgagagcttgtcagccgttgttttgcgtgatcttgcaaaagcgagaggactcaaaaatatctccggcatgaaaaagagtgatctggtagatctgatggttgcagaggacgagcgtcagagcaaagaggagaatacgaagcagcgtgagcagacatcgcagcgtgagcagacaccgcagcgagagcaggcgcagcagcggccggcgcgggaacccagagagggacgggagaacccgaaggagagcggtgcagtggatgagacgatctcgaatctggacagcggaattatggcaaacggtattttagaggttatgccggacggatatggatttatccgctgtgagaattaccttcccggggagaacgatgtgtatgtatcgccgtcacagatccgcaagtttaatctgaagacgggcgatatcgtggcgggcaatacccgtgtgaagacacagcaggaaaagttttcggcgctgttatatgtttcatcggtcaatggttaccatccgggtgtcgcgcagaagcgcaagaattttgaggatctgacgccgattttcccgaaccggagaatccgcttggagcgcccgggctgcagtgtcgcaatgcgcattgtggatctggtatcgccgatcggaaagggacagcgcggtatgatcgtatcccagccgaaggcaggtaagaccaccttattaaaagagattgcaaaatcagtgacaaagggaaatccggatatgcatctgattattttgctgatcgatgagagaccggaggaggttacggacatcaaggaagcgattgtcggggagaatgtggaagtgatttattctacgtttgatgagctgccggagcatcacaagcgtgtatccgagatggtgatcgagcgggcgaagcgccttgtggagcacggaaaggatgtcatgatcctgcttgacagcattacgagactggcaagagcctacaacctcacggttccgccaagcggacgtacgttatccggaggtcttgacccggcggcgctgcacatgccgaagcgctttttcggtgcagccaggaacatgcgtgagggaggaagcctcacgattcttgccaccgcgctggtggataccggaagcaagatggacgacgtggtattcgaggagtttaagggaaccggcaacatggagctggtgcttgaccgcaagctttccgagaagcgtgtgttccctgccatcgacattgtgaagtcgggaacacggcgcgacgatctgctgctggagccggaggagcaggaggctgtcgagatcatgcgcaaggcgatcaacggtatgcgcaccgacgaggcggtggagaacattctgaacatgtttgcccgcacgcgcaacaatcaggaatatatccatatggtgaaaaagaaccggattgtataaaaagaacttgattttttgtaaaaaccatgataaaataacaacgctgtttattcgggactattctttgcaataagtgccatatgcggatcgggcatacgggcataagagaatagagacagacaggaacataataacgataagattataaagaggtgaaaatcatgaaggcaggaatccatccagattactatcaggcaactgttacatgtaactgcggtaacacatttgttacaggttcaacaaaggaagatatccacgttgagatctgctccaagtgccatccgttctacacaggccagcagaaagcagctcaggctcgcggacgtattgataagttcaataagaagtatggtatgcagcagcagtagtatgacgcgcgaagcgttatgctcctaagtgaaaacggttacagataaggttgaggttgtttaatctcaaccttttttaccttatagaatacggcacggttcgtgtgccacaagcagggtttttgactatgagatattcgggaattggcggtcaggcggtcatggaaggcgtaatgatgaagaatcaggaaaaatacgcggtagccgtgcgcaagccggaccaggagatcgtcgtcgagacttcgacgtacgaagggctgattaaaaataagaaaataagaaacatgccgatcttacgtggcgtgttcagttttatagaatcgctggtactggggatgaagacactgacgttctcggcgtcctttttcgaggaggaagaggaggaaaagagcgggtcccggaaagcggagaagcgtgccggagccaaaaagccggcgccgacggaagaggaacagaagaaaaaggaaaagcgtcaggagaatgcgctgatgggcggtacggtggcaatttccattgtgcttgcggtggcgatttttatggtgcttccttattacatatccgtattctttcagcgttttatcacatcgcagacgcttcttgcgttgttggaaggcgtgatccgccttaccatctttatcggatatgtggcggcaatttcactgatgccggatattaagcgtgtctatatgtatcatggcgcagagcacaaatgcatcaactgtattgaacaggggatggatcttacggtggagaatgtgcggaagagttcccgtctgcacaagcgctgcggaacaagctttctgctgattgtcatgctgatcagcatagtcttctttctgtttatccgcgtggataaccggatcctgcagcttctgctgcgcctggtgtcaattccggtgattgcgggggtatcgtacgagtttatccggcttgccggacgctcggatcatatgcttgtcaatctgttcagcaagccggggctcctgttgcagcggattacaaccagagagccggatgattcgatgattgaggtcggaattgcttctgttgaggcggtgtttgactggaaggcttatgtgaaagagatccgggaacaggcatgatggaggttggaaatgacgtatcgtgagacagtaaatctgggggagaaagttctgtccatggcagatattgcggaggcaaagaccgatgcatggtttttgctcgaaatggtgtgtaagatcgaccgcagtttttattatcttcatatggcagaggagatgccggaagagcagatgagcgagtaccagattgcgctgcgcaagcgcgcagagcatgtcccgctgcagtatattgtgggtgagacagaattcatgggactgaagttcaaagtaaattccagtgtcctcatcccaagacaggatacagagactctggtggaagaggcgctgaaggtcgtgcgccccggaatgcgtgtgctggatctgtgtaccgggtccggatgcgtgattgtcagtattctgcacaatgtatcggatgtggaggggtatgcggttgacatatccaagcaggcgctcaatgttgcgaaggaaaatgcaaggctcaatgatgtgccggtgttgtttgaacacagcgacctgtttgaccatgtgacggggacatttgatgtgatcgtctcgaatccgccgtatatctgtacggatgagattgcaaagctgatgccggaggtgcgggattttgagccgatggaagcgctggacggcaaggaggacggtctgtatttttacaggaagatcatcggacagtgtaagcagtatctgaacccggaaggacatctgttgtttgagatcggctacgatcaggggcaaaaggtgtctgcacttatgcgggagatcgggttccatgatgtgcaggtgataaaggatctggcgagaaaagaccgtgtggtgaccggaatgctttagttgattgcgggattggagagaattttgcatagttggtgcagacggttgtctggtgtttgagataagaaaggatgtttgttatgtttgataagttggatgatttactgattcgttttgaagaattgatgagcgagctcagtgagccggatgtcgcgaacaatccggagcgttttcgcaagctgatgaaggagcagagcgatctggcaccgattgttgctgcatataaggagtacaagcagtgcaagcagaatattgcggattccctcgctatgctggatgaggagtccgacgaggagatgcgtgagctagcgaaggaagaattaaacgatgccaaggcgcgtgtggaggagttggagcatgagttaaagattctgcttcttccaaaagatccgaatgatgataagaatgttatcgtggagatccgtgccggtgccggcggggacgaggcggcacttttcgctgcggagatttaccgtatgtatcagcattatgcagagagcaagaactggaagaccgagattgttgaggcggacgagaccggcatcggcggtatgaagagtgtgacctttatgatcaacggtcagggcgcatactccctgatgaagtatgagtccggtgtgcaccgcgtacagcgtgtgcctgagacggagtccggcggacgtatccacacctccacgatcagtgtggcggtaatgccggaagtggacgacgacattgatattgtcattgatgagaaggatatccgtatcgacgttatgcgtgcctccggaaacggtggacagtgtgtcaacacgaccgattctgcggtgcgtctgacccactacccgtccggtatcgtcgtgtacagccagacggagaagtcacagatccagaataaggcaaaagcgtttgctcttttaaaggcaaagctctacgatattgagcagcagcagcgccatgatgcagaggctgagatgcgccgcagccagatcggtaccggtgaccgttccgagaagatccgtacctacaacttcccacagggacgtgtgacggatcacagaatcaatcttaccctgtacaagctggataagatcatgaacggagacatccaggagatcatcgatgcatgtatcgcggcggaccaggcggcgaagcttgcgaagatgaatgagaactagaaaatgtaacagaaacggtctgtgacgcatgtcatggaccgttttttgccttgtcaggaaagctgtatttgttttttgttgtgttgttaggagtcctgtttttagtgccttgtcaggaaagctgtatttgtttttttgatgtcttgtcaggaacaatgagatgtccgggagtatgcacgggtctacagagacaaaatagccgtctgggacccgaaaatgccgataaaagcgggaagaaagcagcaaaaaacgaagtttttgggcacagggagctaaaattgttccgtgggacccgtaaatcggcgattttcgggtcccacagagcaaaaatcctgctgtagacctgtggcttgcgatagtgtcaaatgaccaatgaaaaaaccgagttaaagaaaaaggctcagatgaactttgaaaactgtagatattataggtagtggcagcttgccgccacccttgacagcacgaaaaagaaccgctgtaggtcgattaccgacggcgaagaacttaagaacagttgttttcttatgtcgattacagcagtgtagcagttctttttcgtgccatcaagggcaaaggcataaatgtcttgtcagaacctgtggttctgatggctgggttattacctttggctcttaatctaagaacagttagcggcttcgccgttttgtaagttcaggattgtttgttgaccgagaaagattagaagttgccattttccaggcatgtttgaagcaccatgtagcatctcaacatcattaagaaccttgtatttattgtgtttgtgagggcgaaggaagttatagtaagcaacccaaagcgctagatcatagttggctccgtctacgttgtcaaaaccgttggttggacgatagagagctttataagtgcgattaagtcgcgctatcatctgcttgaaagggcggtattctttagaaacttcatcgccgtttgtaagaccgataatcctggtgatatcaaatttaaaatcttctttgaactcacgataaaactgttgggcggcaagaggatatgcgctgtaaccattagcgataaatttgaaattttcaggaagcttggagacgtgtttgaaagccatacgcatcgaaagaatgcatgcaccaacgtcgcgctccgtagatatgcggtatccaagaaagggaacgactggcagcatccataataaaccagatgtatgctttaattccacggatttttatgtaggtttcatcggcagtaaagatttttcttgcattgtaatcgtagttgtctacgaatggtttgatgcagacagcaactgtcttacagaagttagctacctgttggtgggatatgtcaatgttgtaaagttcttttaaggcatattaggtcttacgaagagacattccaagatttacgtgcatggttaaacaaagccccattacattagaattgaacttggaaaatttaagagaggatgcatttttaggcagagaattaagatccatcttgaagaaatccaaggtgaattcacgatagatataatccattcatagaactggtcttaattaacgattgttgacgatacatattttgcaacttatctcctttggatgtggatatttattgtcaaaatatatatcggatcgaggtaagttgttttttatatgctccgcaacatcagcaaaatcaaggtctatgaattatgaaatttcttcagatataaaatagagaaacatacaatattattggtatccgaaaaaagtataatggagtgcttgataccagctttatttatttagatagagtcaggtaccggagttgactttgtcagtaaaaaaatagaaaaaatgcaaatacttatttgacatagtgaaaaaatactttataatataaagtatcagaagtgtataaaagatacaaaaacagatgagcaatgttgaggtattgtgacggatttgtcaaaataagtcacatggagaaaggagttacaaaatgggagaaattaaactgcaaatcaatccaaagaacagaccggcagtaccggcagtgaactggcagcaggcacgagtattagaaatgcaggaagagtatgcagctgcatttgatacatcgctggtaaacacgatcgaagagatgcgcgcagcatacaatgaagaaagaaagatgtggaacactggcggtcctgtgatggcagagacagttgactttgatgtgccgtatgaaggagataaagtaccggtacgtttacttcgtccggtgaaagcagagaaacttccggttatcttctttatgcacggtggtggatttgtagaaggaaataatgatacacacagtatggcacagagaaagcttgcagcttattcaggatgtgttgtgattggtattgactattcccttgcgccggaaattaaatatcctcgtgcgatcaaagaatgtgttgcagtatgccattatgtatcagagcatgcggatgaatatggaattgacccggagaaaattggatttgcaggagattccggcggagcaaatatggcgatgggagtctgcatgtgtttaagagatgaaggctttgatgtgtccaagattaaaggtaatatcttatactatggtggatatggcttaatgagtagtattagtagctatcagcatggcggaaagtgggatggaatgagtgaagctgatttatcttcaccatcttgttatattgctcctgatgtaaaccgttttgattgtccttatttccacatttatgcaaatgatcttacacatgatgtcccaccgtgtttccttgttgcagcagagcttgatccattaagagatgacagtaagttactttatgagattcttacaaataatggaattcaggctgaatatcatgaatataaaggagctcttcatgcatttatccactacagcaaagtaatggatgacgcagaagatgcattacgcagaggagctcacttctttgcacataactgtggattagatccaagaaatgaataaatgattacgtggtaattgcaattgcagggtactacgctagacggaaggctatcatattagagaatatgatagcctctttttgctttataggaaatttactctgtaatgttccaataaagcaaaaaacgctccgcgaggatgcgaccagatgcatgtggaatatgtctgctaaagcagaatgcatctggcgcgcaaagcgtaacaagtacctcaaagattaagggattcaggaatcttgaagcggacttgtccgctttgtttcacatgaatttacagaaaaaatattgcaaaacaaacgatttttttgaataattttgagccattttgctatcaaacaaaaataaaaataaatttagtgaaaaaatataaaaacaagtagaatagactgatatttgtttaacgattaaacataatgtactataataaaggtgtcgggagtgtgctgaaaatacaaatacagatgtttgatcggggaatttgtgctgtatttgttaaaaagaatgcacacggataaaggagctgcaaaatgggggaattaaattatcaatgaatcctatcaacaaaccggctgcaccggcagtaggttggcagcaggcaagagtacttgagatgcaggcagagtacgcagatgcatttgatactcagactggaagctacgatgaaatgtgtgcagcgtacggcgaagagagaaagatgtggaacagcggtggtcctgaaatggaagaaacgatcgaatatcagatcccttatgaaggatatacggttccggtacgtttacttcgtccggtaaaggcagagaaactgccggttattttctttatgcatggtggaggatttgtagaaggtgacaatgatacacatggtctggtacagagaaaacttgcggcttattccggatgtgttgtaattggtatcgattattttttggtaccggaagtaaggtatccggttgcgatagaagagtgtgttgcagtatgtaagtatgtaaacaccataaatttacatttacatattgaaaaaaccatttggtttcctttaatgtattagcgaccaagcaaatagaaaaaaggataacgcaaatggtttctgctaatacattatgcaagaatgttcttaatgtcaagaatacagtgatagaaaactttaatctttactctgatgaggatggcgtgaaacacatccgtatcaaagccagacatcatttttacataaaatatagttttcattattttataggattcgggtatcaaaataggaaggatattgtttttatttttttgataaaaaagacgaatgaaggcaacggatttggatgaaaaaagattgaaaaatgtggaaaaaatagtccgaggtacaaaaagtgatgcatttcatgaaaaaagacgggttgtttgacggtaaaacaaaagatagatgagaatttagaaaaacatacaaaaaatagcgatatttgtttgacaactgaacataatgagcttataataaggatataagaaatgtacaaaagatacaaatgcagatggaaaatcgggggggatttgtgctgtatttgtcaaaaggttgtatgttgaaaagtgtgtaaaaatttttatgtaaagagaaaggaagttacacgatgggggaatttagagtaacaattaatccaaaaaacaaaccagctacaccagaggtgaactggcagcaggcaagagtacttgagatgcaggcagaatatgcagcagcattcgatactcaggcaggaacttacgaggagatgcgtgcagcataccgcgaagagagaaagatgtggaacagcggcgggccagaaatggcagagacaatcgactttgagattccttttggtgaggataaagttccagcacgtttacttcgcccagtaaaagctgagaagcttccagttatcttctttatgcatggtggcggatttgtattaggtgataacgatacacacaatctggtacagagaaagcttgcagcttattccggatgtgttgttgtaggtattgaatatactttatcaccagaagtagtttatcctcgtgcgattgaggaatgtactacagcttgtaaatatgtattagagcatgcagaagagtacggcattgatccagaaaaatttggattcgcaggagattccggcggagcaaacctttctatgggcgttacaatgcacttacgtgatgatggatttgatatctctagaatcaaaggtaacattttattctacggatcttatggtatgaaagccagtgtcagcagcaaccttcacggtggaagctgggatggaatgagcgaggaagaccttgcattctacttggaaatttaccttggcgaaggcgtagatcctatagattgtccatactttgatacatttatcaatgaccttacacatgatgttccaccttgcttcatcgtttcggcagaacttgatccactgagagatgacagtaagttactttatgagattcttacaaacaacggaatccaggctgaataccatgagtacaaaggtgctcttcacgcatttatccactacagcaaagttatggatgacgcagaagatgcattacgcagaggagctcatttcttcgctcacaactgcggtttagatccaagaaattaatctacatacataaatcgatattcattccaagagggggtcactgtatttatacagcggctctttctttttgaaaatgctgatgtagagatgaaatagttatacggaatgttttaaagaactatgaatagaggactggggaaatttggcgtagggatttttgataagaaataaaaagcagaatgtttgatttgcaaacattctgcttttttggataaaatttacagccggggaggaacccggctgcagcgaaagaatatggtaaatatatattatataggaaaaagctttagtcacagaaaacatagtttctgagtcgatttaatgcttcttcaacacggctctttggaagagcaaggtttacacggattccatactcattatggaatggtcgtccatcctgccagtagacaccgacagactgtccttttttgtaaaggtcttctaatgtctggttgtgtgcagtacaccagcctttacagtcaaggaaaagcatataagtaccttctggttttgcagtatcaataccatcaatgttgctgaagaagtcatatgcgatattgacattttctgttaatacttcgcataattcgtctacccattcatgaccttccggcttataagcaccgatcaatgcgtgcatggataagacattcatgtcgttgtaatggcagagggaagattctttgtcgatgcgatccttcagccatgaattataaataatatgataagaaccgatcagaccggcaaggttgaatgtcttagatggtgcatataatgcaatggtacggttttttgcatcttcagacacagactgtgttggaatatgcttgtggccatttaagataaggtcagaccagatttcatcagaaataacaaatacatcatatttttggaagagttccattgctctttctatttcccaacgctcccatacacgaccggttgggttatgcggggtacagaaaacagcagcatggatatgattttctttgatcttacgctccatgtcttcatagtccatacgccaaaccccattttcatcgcgtacaagtggactcaggaccatattgtagccattatttgtcagactggctgtaaaaccaatgtatgtaggagaatgaaataaaacagaatcacccttcgagcataaaacacttaatgcgctgatcacgccgccgagaacaccgttttcatatccgatatgttcctcagataacccggttacaccgtttcttaacttatgccagttgataatggattcaaaatattcaggacgtgggcggaaatatccgaaagcagggtgcttcgtgcgctcgataatagcgtcctgtatcgttggtactgttgggaagttcatgtctgctacccacatcgggatcagatcaaagccttctttgatcggtgcaaatgagatccagctggcattcataggcggatttactgcaattgcatccatgccgtcgcggtttaaaatacttgtaaaatcatacttcatctaataggcctccttacgtttttacgtttgtgaatacattattttagctcttttttcttaatctttccggtagctgttcgcggaaagtcatctacaaactgccagaaagtaggaaccttaaatttggaaagccggtcactgcaatactgttctaattctgcaatcgtcaggctttctccatcggcaaactgaataaatgcttttactgcctggttgcggattggatccggaatgccgattacggcagcatcagcaatttttgggtgggaagtgagaacacattctacttccaggctgctgatattttcgccggatcgtttgatcatatttccccaacgatcgataaagaagagccagccggcttcgtctatatatcctctgtcaccggaatgaagccatccatctttgtccagaagacattctgtcgcacctgggtcattgtaatatcctggtgtaagagaacgacccggaataccgtggacacagatctcaccggttttacccggggcaacttcctttccgtcacagtcgatgatcttgatatcataagataaagcagcgcgccctacagaaggccagtttttatcaccggagatcggagaacaggtaacggcagaaatcgtttctgtcattccataggagttcagaagctgaacgtggaatcgacgttcgaattcatctttttcttctgtgcttaatcccatagaaaaatagacctgtttcagacaatgatcctgctcccatggttgtacaggctgcagcatcagtgtccggttcataatggacatggtatctgtaaagtttgcttttgtatcacagatctgtttccagaatttatgtgcgctgtaatgctctaccatgatcagtgtaccgccggcaacaatgacggacatagcagccatttcctgaaaatccatatggtaacatggcatacacgaaagaaaacggtctccggggcacatgccaatctgctgcatatggataataccaccatatacgacattgcagtgcgtatagatcacgcctttcgggtactgcgttgttccagaggtaaataggatgacggcagtatcctccggaagaatctcgcaggattcgtccagtcggctgccgtcaaaaaaactacttgctgaaagagagagaatgtccggatccggacattctccccaggctaaaataatggtagagagtagtaaatcttctttattggactgataaataggaagggaagacggctcaacgataatgcgatggatatcacatttctgaaggacgaatttgctttcctgcaggcgatagtgctcattcagcggaacggatacagcgccgatctgcgcaagtgcaagccagcacatcagatattctggtgaattgtgcagatgaagtgccaccagttcgcctttacggattcctagcgaatgaaaccagtttgctgtctgaataacacggtagtgaaattcagaataagtgtagctggtaagctggtcatcaactgaaatatattccagaaaattctgattaccataaaattgtacagtctcattccattgagaggaaagagtgcggttacctgcaatatcagtcatgatttctgcctttcattaggataatttttccgttaaaagtgggatgatcttatacatatctccaacaagtccaaagtcacagtttttgaaaataggtgcggacttatctttattgatagcaacgatcactttggatttgttgataccaccgatatgctgaacctgtccggatacaccagtacagatgataagatctggcttaacctgaacacctgtgattcccatgtaggaagattttggtaaccatttgttgttctcagcgattggacgggaacatccaacttcaccatcgatagcagaagccagcttctcacacatagcaagatcttcctgtgcagcaagtccacggccgacatcgacgatacgttttgcagcaacaaggtttacagctgtttcacgtttctcatctttagaaacacgttttaagcttgcggatgcagcaccggcgattggagcgatgtctgtgcaggcacctgttccttctgctgctgcgaagattccgctgtttacagtgaatacactgtaagctgtttcaatcacctgtttgttaacagctgttccaccgaatacagtacgctcgaagcatggtttaccgtcttcagaagtaagagaagagatggttgcgaacactgctgtgtttaagtaaacactgagttttcctgcaagagcacgtccaaggattgtatttccaacaagaacgcaggcagcatcagattttaaaatctcttctgcgatagcttttgcaaaatcttccggagaaccggattcttctaatggacatgtaagaatgtggtctgctccacactcagctgcagctgcaccatcaccgaaaacaacagctgtaacatcggaagcaacgtttcttgctccggcacagagttcggataataaagcattattttcactaattacataagattgcatatctaaaatcctcctttaagcctataaagcttctttcttaaggaaagcaactaaagcgtctactgcttcttcgttgtctccttcgataatttcctgacgtctctcctgctgttctggagcaagctgctcaagagtagatgcagaagcgtttaaatctgcaagatctgtagtaagaactgcaaccggttttttacctgcctgcatgatatcacgcatagctggaacagtcggaacgttgatctcagatgaaacggaaagaactgctggaagtgctacttcaaaaacttcagtgctgttctcaagagtacgctcaacaagaacggtatcaccgtttggctggatggaagttacgttgtttaaggttggccagtcaagtaatgtaccaagctggatacctgttacctgattgtagagatcggaagaaccggttccgcaaagaacgaggtcaacttcttcctgctcacggattgctgctgcaagagcttttgctgtttcaaaagaatcagagaagctgtgatcgtcgctgatcacaagttttaaatcatttgcaccacgggaaaggatatctttacggatctttgttgcatcaagagctttggaagaaccaacgcttaatgcggtaacggaaccctttgtctctgcagaaagcttctttgctgcttcaagggcgtttaagtcatactgactgatttttgctggtacatcatcaagagccagctctctgttaggaagaactttgatctgttcttcatccggtactactttacaacatgtaataattttcatttgctcacctgctcctaaaattattttttgtggtgttttaaactgtttcaatcatagaaatagaagatacaataccatgcgtcgtctcaaattgtcttgaattgtttaaaaattgtatggtaaaaaaacaattttgaaaaatgaaacaaatttaaaacgggacaaaatgttaaatttgtaagcttatcttattatgaataaagcgcggtgtcaacaataaaactgtaaataattgaaaaaaatatcgaaaaaaaataaaaaaaagcttgcaatttattcaaaataacgaaataatagaagtatgataaaaataaaacgaaatgtttgaaacgaaaatgaattgttcggacgtcaaacaaaacaggaggaggttatcatgaaacctttggaagcagtatcggtattggatctcactgagggaaacccgtatatcggaagcgtgtttgcagattacggggcaacagtacttaaggtggaaaagccacagggcggcgatgatatccggcgccggggaggaacaccggaggaagaaggaccatatgcacagtactatctgcgcggcaagaagagtattgcaattgattacacaacagcagacggtcaggagatcgtaagaaagcttgcagcaaaatgtgatatggtagcggtaaataaacaggaagattatatggaaagactcggattggggtacgagaacttaaaagcagtgaatccgaagcttatttacggagtgttaacaccatttggtaaagaaggaccatggaaagattgtcctgactatgacctgatcgttatggcaaaatgcggactgcttgagaagaccggttttccggagagaccgacaaagtttggtttcccactggcttacatttatgcaagctggcatctcacagccggaatgatggctgcatatctgaaagcagaagagagcggcgagggcagtaaagtttccgtaagctcatggcatacgatgatggagcttgatgatacttttgcagaatgtatgcagggactgaatgtgttacctagacgtctcggcaacggattcccgacaacgaacccgactgacacattccactgtaaggacggctggttcgctttaagtatcggaagcgataaacagtggcttgactttgcaagagaggccggcagggatgactggggagagggaagcgtatatgcacacgacccggatcgttccatgaagcattacttcggagaacttgaccagcagttaaaagactattttgcaacgatctcaattgatgaagcagatcagatctgccgcagggcaatggtacctggcggaccttgcaatacagtagaagagctgatgaaggatgaacaggttgcagaccgtggaatgatgatcacggtaggcggagagacacagatcggaattccggcgaagttctccggtgcggatgatcttgataacatagaacctggtcatgtgcttggtgcagatacgcaggcagttctgacagaatacggtgtagaataaggagagtcaaaggctatgggaacagagaacagaaagggaccattgaaagatgtaaaagtgcttgattttacgattgcacttgcaggtgtatatgtggcatggcagtttgcagatatgggagctgaagtctggaaagtagagcgctacggcagcggcgaccaggcaagaacatgggatccattcgtaaacggattaagtactctttatacagcatataataagaataagcagagcattgagctggatctgtcttctcaggaaggcaaacaggtcatctacgatatggtaaaggaagcagatgtcgtacttgaaaacttcaagagcggttccattgacagactgggacttggatacgaagaactgaaaaagatcaatccaaagatcgtgttcgtatcactgagcggattcggagcgacaggacctctgaaaaaatatccatgttatgatgcaatcgcagcagcccgcggcggatttgcaggaagcaacggagaaccggacggtgcaccaatgaaagcaggaaatgcaaattgtgataccttaaccggaacacacgcattaaacgcagcgctgatcggcctgatccaggcacgtaagacaggagagggatgcagagttgatatcggtatgatggatacggtaatgatctcctgtggtgagactgttgtcgattacggaaaaggaacttatacacagtcaagattcggtaatcatgaccgcttcaccgcaccatacggaattttcgaagcaagagacggctgggcagttatcattgcagacagcgaggaacgctgggcaaagatgtgtgatgcattagatgccggacacttaaaagacgatccaagatttgcagataacgcggcaagaatcgcaaacagggacagcctggtagaagaacttgaaaaagtaaccgttacttataaacggagcgagatagaaaaacgcctgacagaagccggggtaccggcatctgaagtacttccttttattgaagcatatacttcagaacatgcaaattcaacagagacgacaacacttgttgatcaggaaaagattggacagatgagattctataacaatccgatccggttcaacgacgagttatgcccgatctggagaggagcaccacttcttggcgaagacagcagagagattcttgcaggacttggatacagcgaagaaaagattgaccagctctttgcagacggtgttgtcggaagcagcatgatttaatcttggatcacagatagaatacaggttttgcgtaggaggaaagatgcagataatcagagtcccggtaggggcatttatcacaaactgttatattgcagaaggacaggaaccgggaagaggatttctcgttgatcctgcagataatccgaaaaagctgatctccatcctggaggaaaagcagatctgtccggaagcaattcttctgacacatggtcattacgatcatattcttgcggtaccgaagctgcaggaacgatggaaagagattccggtgtattgcaatgcaaaggatattccggagagtcttacggagtatgatatgggacagcagttcccgacagtcagggcatttaagaatgtgaagacgatcgaagatggacaggagctggtgatcgcaggaacagagatcactgtgatggaaacaccgggacatacgccgggatccgttctgtttctgacaaaggatgcaatctttaccggagatacgattttccagggaagtatcggaagaacggactttgaaggtggaaatgagcgccagatgatgcagagcctgagaaaaattaatcatcttgccatagaggacattaccctatgtcccggacatggcgacacaaccacattgaagtgggaaagagcacataacagctatctgaagatgtgcagatagctgtaaatgatagaaaaaatgaggtgacaattatgggggaaacaaagaaagtacttactgaactgaaaaatggcgtattgatcgtaacaatcaaccgtgaagagcgccgcaatgcaatcgacccggaaacatccgcaatgatggaacagatcttaaacgatgctgaacagaatccggaagttggcgcgatcattatcacaggaacaggcgacagaagcttctgttccggagaagatttagcagcttatgatgaaaacggaacctgtcagacaattatggcacatggatttgcaggaatcacagaacgtctttccgcaaaaccgatcatctgtgcagcaaacggaactgcagtagcaggaggtcttgagatcgcacttgcatgtgacattatcgttgcatctgagaatgcaagattcggactttctgaagtaaaagtcggattcctggcaacaagcggaggactgatccgtttaccaaacatcattcctaagaagatcgcatctgagatggttctgacaggaaaactgatcgatgcacagcgtgcttacgaggtaggtcttgttaactatgttgttccaagagaacaggttatggacaaagcaatggaattagcagagatcatcgctgcaaacgcaccgatctcattaaaactcagcaaagagattttccatgtagcaacacagtgctctttcgaagatgcacagagatattgcaatcgctgctgggattacatcgagaaaacagaagatgcagtagaaggaccaaaagcgttcttagagaaacgcaaaccggactggaaaggcagataataacaagtgtttggcatggaatgaaaaaagaaaccatgtaaaatataattaagaaaaataatggaggaaataatatggatttcagaattacagaagaacaggaattaatggtacaggcaatcgaagaggctatgacaagagaaaatcttgagccttacttccaggactgtgacaaaaaccacacacatccagagaaatggtgggaaatcttaaaagagctcggatgctttagtatgttcttaccagaagaagctgaaggagaagacggagaaccaggtggcggcgaaggcgcagttacaatgttcctcgtaatggaagctttaggacgctgtggcgcaccaatctaccttttctgggatcatgtaaaagctgatgcacttttagagaatggaacaaaagagcagatcgataaattcatgcctttattcttcaaaggaaacggagcattcgcacagggattctcagaaccaactgcaggtactgaattatccagcaatacaatccttacaacttatacacgtcgtaacggaaaagtatacatcaatggacacaaacatttcatttccggagcacaggacaatgattactgtctgacacttgctaaaaacagcgagaatccagaacagcttacattatggtttgttcctacaaacgttccaggctgcaagaaagagccaatggaaaaaatgggattaaacatggaaaacgtaaacgacatctggtttgatgatgttgagatcgaagaaagcgatatgttcagcttcgaaggaaacggattaatggcaacatccaaaggttttgattacgagcgtctgatcgatgcattcaacgcatatggacaggcattatgtgcatacgaagatgcatgcagatacgcaaaccagagaatcgtaaaaggtcaggagatcggacgtttacagctgatccagaaccatatcatggaaatgaccatgaagatcgaagctatgagaaatatgcttcttcactacgcatggaacaaagataacaactgcctgacaagagcagaggcatctattgcaaaacagttctgttctgaatctgcaaatgatatcgctgaccatgcactccaggtaatgggcggaatcggatactgcggaagccgcgtaagccgtatttatagagacttaagaatcacacgtatttccggtggaacaggtgagattcagacagttattgcaagccgtcaggtattaaagaaatataaataaagagagaggaatggaggatatttgcaatgaagaatattcttgtctgcattaagcaggtaccggatacgacagaaatccgtatcgatccggtaaagaaaacactgattcgcgaaggagtaccaagtattgtcaatccatttgatgcatacgcattggaactcgcagcaagaatcaaagataaagaaccaggtacgaaaattacattagtatctatgggaccaccacaggcagagaatgctttaagagagtgtcttgctgtaggcggagacaaagcataccttgtcagcggaagagaatttggaggaagtgatacacttgcaacaagttacattctttcctgcgcaattaagaaattagaagaattagaaggaaaattcgacatcatcttctgtggaaaacaggcaattgatggtgatacagcacaggttggacctgaaatcgctgagcatatcggacttccacaggtaacatatgcgatcgaagcagaagctgaggaagacagacttgtgatcaagaaagaagtagaagccggatttgaaaaggttgcagtttcttacccatgtctgatcaccgtaacaaaaccatccttcgatcctagattccctaccatcaaatccaagatggctgcaaagaaagcagagatcaatgttctcgcctatgcagacttagaagctggtatggataatgagagaatcggattaaaaggttctccaacaaaggttaagaaaacatttaccccagaagtaaaaacttcaggtgtgaagatcaatgaaccgacatcagaagaaggcgcagaaaaattatttgccattctctgcgaagataaagtattttaaggaggtgaaaagagatggcggtagaaaagacaaaggatctttgggtctttatcgaaacagaggatgaaggtactgcgaaaagcgtaggacttgagttactcgttccaggtagaagacttgcagataaacagaacggaaaacttgttgcagtaattttaggaagcaatgttgcaccagcactcgaagctgtaaaagcacacggcgctgacgaagcaatcgttgtggatcagcctgaattaaagcactataacacagatgcttatgcaaaagttctttgcgaactgatcgaaaaatacggaccatccgtaatgctgatcggtgctacaaataacggaagagacatcggacctcgtatttcctgcagacttggaactggtttaacagcagactgtacagcattagatattgatgatgagacaggcaacatggcatggacaagacctgcattcggtggaaacctgatggcaacaattatgtgtcctgaccacagaccacagcttggaacagtcagacctggcgtattcaagaagagtgaaccaggtgaagtaaaagacattccggtgatcaaagaaaaagttgagatcacagatgcagaaaaacgtgtagagttactcgaagtgatcaatgagatggcaggggaactcgttgatctggaaaacgcagaaatcatcgtttccggtggacgtggagtaggcggaccagaaggttttgcacctgtaagagagcttgcagaagtattaggtgctacagtaggagcatccagagcagctgttgatgcaggatggatcccacatgcacaccaggtaggccagactggtaaaacagttggaccaaagatctacattgcctgcggaatttccggagcaattcagcatcttgccggtatgagcagctctgacgtgatcattgcaatcaacaaagatccagatgcaccaattttcaatgtggctgattacggtcttgttggagacctgaaagtagttctgccaattctgacagaaaagatcagaaaatacaaagggttataagaagtagccagaggttttttgattaaaaaagtaagagaagagaggtaaaacactatggaatttaaattaaatgaagaccagcagttaatgaaagacatgttcgttgaatttacagagcagtttgtcaaaccaatcgctgcagagttagatgagcaggagcgcttcccggaagaactgattccacagcttggagaaacaggacttctcggaatcccggtcgctgaagagtacggcggagcaggtgcagacaatatgtcttacgttcttgcagtagaagaagtttctaaagcatgcgcaagcacaggtgttacaatttcagctcatacatctttatgctgctggccaatcgaagcattcggaacagaagaacagaaacagaaataccttccagatcttgcatctggtgaaaaacttggtgctttcggtcttactgagccgggcgctggatctgacgctgctggacagagaacagttgcagaagacaaaggcgatcactacttattaaacggaagcaagatcttcatcacaaacggtgaagttgctgatgtttacgttgtatttgcaatgacaaacaaagaacttggaaacaaaggaatcagtgctttcatcgtagaaaaaggatgggaaggattcagctttggaagtcatgagaagaaaatgggtatccgtggatcttctacatgcgagctgattttcgaaaacgtaaaagttccgaaggaaaaccttttgggagaagttaacaaaggattcaagattgctatggcaactcttgatggcggacgtatcggtatcgctgcacaggcacttggtattgctgaaggcgcattagacgcagctgtagaatatgttaagacaagagaacagtttggacgtcctatcgcagcattccagaatacaaaattcacacttgctgatatgaagacaagagtagaagctgctagataccttgtatatagcgctgcttgtgcaaaagataacggcgaaccatactctgacaaagctgctatggctaaattattcgcttctgaaacagcaagagaagttacctggagagcagtacagttattcggtggatatggatatacaagagattatccagtagaaagaatgatgcgtgacgctaagatcacagaaatctatgaaggcacttctgagatccagaagatggtaattgcaggaaatttgctgaaatagtttctggagacagaaatggaggatgatacgatgggagaaatactattttcagtcgtagttggaggctgtctgatcgcttcaggaatccttatgattttcgtccttgggaaagaggaaaaaaaggttagaaaagataaggaggatgttgcatgaatatattctttataggagtggttgtcagcatactggtttacatagtggttggaatctgggcaggtcgttctgtaaaggacgtaaatgactattatgtcagtggaagaaatgccccgacgattttgatcgccggaaccctgtttgcatcgatgctttcggtaaacgggttcatgggagaccagggatggtgctattccggcaacattacaacactggtattgctaaattccatgtgtgcaatgggttatattgccggaccacttatgttcggacgatatttaaggcggtcagaatgtacaacaatgccggaatatttcggagcgcgttactgcgatctgaaaaaccggagagttgccggaattattacagcagtttccctcacagcgtatttgctctcatgtatcaccggagttggaattttaatgcaggaactgacagggctttcttatgagctctgtctcttcctggcatggttttgttttaccgcttttactttttattccggttcgaaaggagttattcttacggatacgatgatgttcatggtatttttaatagcgacgatcattgccggtccttatgttttcaaggcacagggtggaattggtcatctgctggagaatctcatgaataatccaaacattccggagaaccttttggattatcatggcaatattccaggagccggggcaacagatgtttttggtgcagtgatgtatgcagtgacgatgggaattatctggtttattacagtgtcggtatcgccttggcaggcaggacgtaacatgatggcaaagagcgagcatgttacattccgcgcaggtgcgatcgcagcggcatgtacggtgattttcctgatgtatttgaatctgcagtctgtgaccgtactgaatcttaaccctggaatggaagatccgcagagagttctgatctgggcagcatttcatgtaatgccgaagttcgtcggaacattgatgcttgccggcattatggcagcaggattatcttctgcatccacattcctgtcggtcattggattttctattacatcggatattgtttttgtggaatttaaaagtgaaaagcagcagttatttgtcagcagagtgataatgctgatcctcggtgcgatttccttactgttagcatatacaggaatcggaagtgtccgcatcgttacttattttgcatctacgatcatcgcagcaagctggggcgtttccgccatcggaagtgtggtaagtaaaaagctttccgctaccggagcgagatggtctatgatcgccggatttgttggattcattgttacaaaatgtctggttggatttcatgtaggattatttgcaactgtatttattaactttttagacccattctttattggaatttacctgagcctcttttttgcgatactcggatcaaaattacatccggtgacagaggaggaaaaagcatatcgggaaaaacttctgatattaccggagtctgaaaaggtaataaaagattacaagatcgacaaagtatttggatatcttctgatcgcagcaggaattgcagtgacactcttccttttattcggctgggcgctgccatataacggaatcatataaaataatgatagagaaaacgtggaggggaaacgttatgacacaaaaatcaaaaagcagtaaagtagttactctgattcttatgatcctggcaatgaataccatttatatgttgccatacctgatgtatacatactatacaccattacaggaggctatgggtcttattggaagagatgctgactatggtagattattaaacgtatatggtattgcaaacgttattttatacctgccaggtggatgggtagcagataaatttgactgcaagaagttacttgtattttccatggtttcaacaggtgttcttggtctctgggaagcaacattcccaagctacacaatcctgttactgatccatatattatttgcagtaacaaccgtacttacattctggtcttcttctgtaaaatgtgtcaacatgctcgctgatgagggagaacagggtggtatgttcggaagcctggaagcaggacgtggtgtttcaggtctggttcttactattatctttacatctatttatgcagtaaatgcagctgacagcacaaaggcaatgagattaaatgtgtcaattatctcagttgttatgatcgtgatcggtattcttttagcagttttaatgccgaagccaaagaatacagaaaatgcaacaaatgctacattacttgacagtatcaaagcgatgggtgttgcattcaagtgtccagttacttatctgttagcaggtatgatcttctgtggatctatgtgtcttgcatctacaacttattttgcaccatacttacagaacatttgtggattaccggtaaaaatcggtgttttatattcaaactacagcaagatcgttacacagttaatcgctgcatctgcagctggtattttagcaactaaattaaaacgttccacaaaacctatgatcgtagccggtgttgttggagcaggtttatatattgttatggaaatcttaccagcatctacagcagttatgtggccaatgcttgttgtaatgacagttgctcttatgatgatctatgtattccgtgctctgtattacgcaacagtagatgaggaaggaacacctaagaacatcgttggtagtgttatcggtatctcatccttaatcggattcattccggatacattctacacatcattatgtggtaaatggctggaagctgatcctgtaggtggatacaaaaagatcttcttaagctgtattttggctatggtaattggtcttgtttgtgcatttatttccgatagaagaatcgtaaaattccgcgcagcaaacaacaaagaagcttaattaataagaaaaagattagtgtgttgaaagaataattcaagcgttgatacgttgaataaaaaaagacagagtgtcctaaaattggatactctgtcttttttcatgattcggatatggagggtcaaaacgtttgttttataaacttaaatgcaaacgttttgacaccctactctgattcggtaaataaatgtcagaaaaaacttcctgtttttggggagaaaaaagagagatataaaaaccttgtgtttttaaatatctctctgctaggattcttcatcaaaagcttttgacaataatttaacatattcatgtaagactttacaaaaagaattcatttcactgatagagcagacctttaatagttctgactgtatctctgttgttttttttgtgacaaaagcgatataaagggtattcagacgttcaccgtccggagtagtgtatagatgcactacttttgcattaccgggacgcttttcgcggtaaatgtagccacctttttctaggttggaaacaatggatgaaatagttccttttgtccgatgttgtttttgggataaatcacttacggtaatccctggattttgttcaatcgtagataagatagcgacttcgacagatttgatcggacgatcattaccgtagtcacgagttccattttgcatatctgtgaacagcatagcgaacatggaaagatcactggcataggcgatgagattcgtactatccttatcccctgtattgtaatattgtaccatgtatgcggtacctccttgaatgattgcatatcagaataataatgatatatatatgtaatatatcatgagaaaataggaatgacaaggaaaaacggggaaaaacagggaaaaggacagaaaaacatttctatacaagaattaattccaggatcaatacaaccgtacagcagccgacagatacttgaaacagacttgcgccaaaccatgcaccgatcatcccaaaaacgagtgcgatagcacctgcaacaggactttgtgttgcttcgatgatcgcaggaaaagtcatgacggataacgtaatatatggaacataatataagaaagactggataaattgatttttgatcggttttcggataagagtcagaggaagcacacgggtcgtgtaagatacaagtgccatgacagcaatataaaaataagggttgtgtgtcataaaaaaactcctttcgatagtgaagacagagtgaaatatatgtaatgtttcaatttaggtagttgcatttttatctttttccggggtgaccgggaataggatcgcagcagcagaagacaggatcaccgtcaaaagaatggtccttgttccacttgaaagagaacgggttcagatagccggggcgtgcaattgtgatcccaaacagcttgtcggtcacatcataggcgataaaaagccgatggataaaaggggtgtcttccgagaagcgttgtgcaagtgcacagctcatcaaaagataacgggcattggagattagcgtgatgatcgcaacttcaagataagtggcatttgctgcgatcagtgtaaaagcagcatattcacctgctgaggcgttattgaggaggctggcaagaaatccctgtaaaggattcagaccggcattccttgtggcgattccaagagaaaaggataccgcaaaataaccgagtgcgatcggaaatccgtcccgcattccttcggtgaaaactttccggctgaaagtatagaccggatgttggcttgttttgaatgtctgtatattgtgattcataaaaattctcttttcatcaggttgttaatatcaaattaactatgtggaagagatgatggggaaatttgaaaaagataccggaacaggcagatttttcaaagattttaagaaatatcatgggcttccggttcaggatgccattttctttaaccagagtgatctgatctgtgatatggcaaagcacgaggactttattgttatgggaagatgtgcggacgttgtactcacgaatcatcatatcccacatatcagtattttcatcacagcatcgtttgatcagagtgtacgccgtatgatggaaataaacagcttaaactacaagcaagcggaacacctgttaaagaagttagataaacgccatgaacgttattatcatgcatacaccggtaaaaaatggggtgatgcggtcaactatgatctgtgtattgacagtgcaagttacggaatcaaggaatcggttgagctgatcgagcgtatgatcaataagtatccgaatagttaaaaaataatttcatatatgtaaacacattgcacaaaaagtagtgttttttttctacactttagactctaaaatatattgactttagtttctaaaacgagtatgcttttattaagataaaaaatatttcatttaaggagaaaaaagtatggcaaacaaagaaatcaaaacagagcaggcaccggcagcaattggtccatattcacaggggatttcagctgaaaacatcgcatttgtatcaggacagctcccaatcgatcctgcaacaggagagtttgcaggtaacgacattgcaagccagacacgtcagtccctgaaaaatgtgcaggcaattttagcagagaatggtatgacgatggcagatgtgacaaagacaacagtacttcttgctgatatcgcagaatttgcggaaatgaatcaggtttatgcagaattttttgcagaaccatttccagcacgtgcagcatttgaagtagcagctttaccaaaaaatgcgaaagttgagattgaggcaattgcagtaaaaagataagaggaaaatgaagatgagcgtagattttaaccgtgaggtcgatcgtagaagtacaagtgatgtgaaatggcgcccggaaggattaaaggggtatcttccgatagaagtttcggaaaatgagatcccgatgtggatcgcagacatggattttgcatgcccggagtgcatcgtaagagccatcaaagaaagagccgataaagagatttttggttattgctcttataagcaagagtattatgatgcattaacctggtggtttgataagcgatttggaatgaagatccatacggaccttgtttccatgatgccgaccgttgtcagtgcgatcaatgttgcaatccgtgcattcagtaatccgggagataaagttattattcagcaacctgtatacgatccatttgcagaactgatcaagaaaacaggaagagtaatggtgaacaatggcctgatctgtaatgatggactatatgagatggatttcccactgcttgaagaacaggcagcagatccggatgcgaagattatgattttatgtagcccacataatccggtgggaagagtctggacaaaagaggaacttgcccgtgtcggtgagatctgtaaaaagaacaatgtccttgtgatcgcggatgaaatccacagtgatcttgtatatgcaggatatgttcacacaccgtttgcgctggcaagtgatgcaccgcatctgttgtgcacatctcttggaaaaacctttaatgtagcaggacttcgccttgcgaatattttcagctcttcagcagaactgaaaaaacagtatgatcaggagattgatgcttattcatacagcgcatccaatacgtttggtttggagatggtacaggcggcatattcaccggaaggagaggcatggctggaagaattattagtttaccttcagggaaatgtggaggttgtttcagagtggtgtcaaaagcataatgtaggatttacagcaccgcagggtacatttttatgctggctggatcttggcagtgccggactgacagacgaagagattattaagaagattattatgggaaaagaagtgatctgtgtaccgggaccatggtttggcaaaggcggcgaaggtcatttaaggctgaatattggctgtacaagaaaaacgctggtagaggctctggatcggatcgcttctgtattaaataactaatttcagaaaagcacataaatgcagctttgtagaacaaaaggaggagggtttttatgctgacgaatgaaataatccgcctgcaggcagaagcacagcaggattatgtgattgaaagccgacgtaccattcatcgttttgctgaagtaagcggtaaggaattcaagacaagtgcttttattgaagaagagattaaaaaagccggtctgccttatgaaaaagccggtgataccggttggatcgcaattcttgacacagggaagccaggatcacgtattgcgctccgggcagatattgatgcgcttctggtaccggaggagccaaataaccttgcaggtcctcgtgttgtagtgtccgatgacccacatacgagtcatgcatgtggtcatgatgcccatacagcaatgttattaggagctatgcgtgttcttgcagagcaacgtgataatctgacaggcgtgatctatttctgctttgaagaaggagaagaggatggcagaggaatattggctatgttaaatcaactcagcgcccatggtgtggacgtttgctggggaatccatgtttatgcaggacttgaatccggaaagatttgtgttagtgccggtccacgaatggctggtgctgcgggagtcggcattaaggttatcggcagagggggacatggctccagaccggatatgtcggtaaatcctgtattttgtgcagcctctattctgaccaatacagcgacggcctgggtcaatcagattactgccggaagaacggttacgttaggtgtgaccagtatccagggtggtgaagcaccaaatgtcatcccggacacagcggatatacttggttccctgcgtttcttcaatgatgaagaaggagaaaaagctgtccgaatctttaagaatgtagcagagcatacggccgcaatgaataattgtcaggtacaatttgatgatcgtttctgtgttttatgtgcgccagtgatcaacgatgagtattattcaaatcttatttccactgcattgccggaggtacttccggagaacgtaacggtttcctcttgtgagccatggtatgcatcggagtcattctcctgctatcgaagaatttgtccgagtgtactggcacaccttggaattaataatccgtcctacggttcgggtgcagcacatcataatggtttctttgatgtggatgaaggagtattatctaccggtgtgatctctacactgaagtttgttgcaatgctgcaaaaataaaaaatcatacgcagcaaaatagcaagtgctttactgctgaatgaacattaacttactgccgtaaaatgtttccttgcaatttttggaattgtctgcaataattctatatgcggaggggatagagatgaaggaacagcgtatcaaattaatcggaaagttattacatcagcagggaaatacagcaagagcttttgtacagtatatggattcagaccgtgagtatacggcaggtgataaactctacatgagagaggcacactttgtgatcgcgatcggtcccggtgaaggacgtactatgtctgagattgccagagagatgaatgttacacagggggcagtttcgcagatcgcatcacgtctggagaagaaaggatacgtctgtcgcaggaagaatgaagaaaacaaacggcagatcattgcgtttctgactgaaaagggagagcagttttacacagagcaccagcgatacgacgaaagtatgcacaggcagatggatgagatcgccctgaacaggttcaatgaggaagaactacagtgcatctttgaatatgaacagatcatggaaatgttgctgaaagaagaagcgcttacgcggcatttgacagagaaaagtaaaaattaaaaattttgaagaaaacgaaaaagagccggatatctgaattttgagatttaatctcataggatatggaaggctctttttttatgaaaggattcgggtgtcaaaagatttgcatttaagtttatactggcagattgcacaaaaaatattccaagtttcattgtgcaaaacattccgctaagcaactcaaaatgataagcagatttcaaaatctatcaaaagatttttacgagatttcatgtttcttcagctttgaaagcgtccaatgcctacaaaaagaaaggcgttccagtaatggaaattttccagtatctgtttctgctgattttttctaacagaagcatgtacatgaacctgatcacacgacggaacactcctgattttgcgaaggatactgtatatcgttttatgaaaatgattcagattaactggatccgtttcacaacaatactttcaacccgaatcatcaaggatgccattcttcctttgaattctgaggatcgtgcaaatgttcttatcattgatgattgccagactgaacttcagacagcaggagccgactcatattatggagaacattgtttataatgagctgcttgtgcgtggttacaatgtggatgtcggtattgtggatgtatttgcaaagaatagtgagggaaagagggttcataagcagttagaggttgattttgtagtgaaccaggggagtcagagatattatattcaggtagcttatgatatgacttctgaggagaagcagacacaggaacttaattcactccgtaatattccggattcatttaagaagattattatagtaaatggaacaaaaaagccttggagaaatgaggaaggatttgtaatcatgggcatgaaatattttctgcttaatgcagatagcttggggttttagtttggaaggagataatatattccgattatagaagatatggatataaagttaaatccgattttccgggagacttacacgcttggggatgtcggtgtaaaggagaagggatatacatcacggaagcctgcatgggatgcgacgcctgcgcggcagtatgtccgcagcggtgcattgaggagggcgcgccgtaccggattcatcggaatcattgcttccgttgcgggaactgctgtgagaactgtccctcgcacgcgattgagcgaaaatgagaaaaaacgattagtcgtacatatcacgaaaaaatgaaaatgccagaaaattcatgcttaaatgataaaaaatgcgaataataataaaaaatgttttcattgactaacagatattgaggtacttacaatgggaacaaaaggagggggtttttatgtatgcattgtcaaaagcacaggcaggagatatatgtacgatcaagtggatgttcgggctgccggaggcagtcgattttctgcgccagcatcacgtggaggagggagagaccatacaggtcatccgtaagctgcgggacagtctgatcataggggtgcagaatgagcgggtggcgcttggaaaagaaatcgcagaccgcatacaggtttaaaaagaaggagggcagagcacttgttgcgctgctctcctttttgtgtaataggaacgaagtttcctattacataaaaaagtctgtcttctggcaagaaaactggtcataccagattccagatggcagattgcacaaaaacagaaccgtaaatatagtgcaaaatagcgttgatttcacagaaaaagtgtgttaaaatttagacaaacatgaggtatgaccagaacgcaaccgaacaaaggaatacctcggcacagggaaaggggcatacgaatgagtgagtttaaggtgattgaaatcaagaagaacattctggaagacaatgacagagaagcagatgtgcttcgttctgagttaaaggcagacagaacatttcttctgaatctgatgtcttcaccggggtctggaaagacgaccacgctggtgcggacgataggcgcgttaaaagacgagatgcgcattggagtcatggaggcggatatcgattcggatgtggatgccgacacgatcgcacagactggcgcgaaggcaatccagatccatacgggtggcatgtgccatctggatgcggacatgacgagacagggcattgagagcctcgagacaaaggacgtggatctcgccattctcgagaacgtcggcaatctggtctgccctgcagagttcgatacgggagccgtaaagaacgccatgatcttaagcgttccggaaggggatgacaagccgttaaaatatccgttaatgttttccatctgcgacgtgcttttgatcaacaagatcgatgtacttccatactttgattttgacatcgaggcatgcaaagagcgcgtgaagaagctgaacccgaacattcagatcattccgatctcttcccgcaccggcgaggggatggatgcgtggtacgactggcttcgcacggaagtaaaacagtggaataattaaaaactgccggaagcggcatacatattttatgggtatacacaggctatgagtatgcgcactcttagagtgcgcactatttatgcaaatataagacgaaaacagacgagacagaataaaaaaacaggaaaaacaacgaaaaacgaaggaaaaaggagactgttatggcagaagaaagagaactgattttaaagctcgggaaaaagattaccgaccgtattccgtacaagcttggtatggagaagctcacggtaaacgatccggaatactggggtcttgcaggtgtggttaccgatgagatggcggaagtggcactgtgcatggacgtgcgcaagccgattacccttccgaagctggcaaagaagaccaagaagccggaggcagagcttgagaagctgctgcaggagatggcggttgtcggaatcatcgagtacaactgggagaatccgcagcatgagaagcagtacattctgccgatgtatgtaccgggaagcgccgagttcatggtaatgaacaaagagcaggtggaaaagcacacagaggtcgctgatttctttgagaatatgtcaagacttccgttagagaaggtgacaccgatggtgccgctcggcggagccggtatcggtatgcatgttatcccggtagagaaggcaattccggcagcgcaggaatctgcagatgtggaacacatttcccactggctgaaaaaatacaaggacaagtatgcgatcgggcagtgttcctgccgtctgcagcagagagtccgcggagagggaaccggcgatatcgagggcgagtggtgcatcggtgtcggcgatatggcagacttcctggtacagaccggaagaggacactatgtggagcttgacgaagtgttagagcttttagagcgcgccgagaagatgggttatgtacatcagattaccaatatcgacggcgaggataagatttttgcaatctgcaactgtgcagtcggcgtctgcaacgcgctgcgcacctcccagctgttcaatacaccgaacatgtcccgctctgcataccgcgcacatgtgaccaaggaaaactgtgtggcatgcggccgctgcgtggagtattgtccgaccggtgctgcaaagctcggacagaagctgtgcacaaagaacggtgagatcacttatccgaagcaggagcttccggatgcgacaaagtggggaccggagaagtggagcacagattaccgtgacaagaaccagatcaactgctatgagaccggtacagctccgtgtaagactgcctgtccggcacacgttccagtacagggttatgtgaagatggcagcggaaggcagatacatggatgccttaaagctgatcaagaacgagaatccgttcccggcagtctgtggttctatctgtaaccgccgctgtgaggatgcatgtaccagaggaacgatcgatcaggcggtagccatcgatgagatcaagaaattcatcgcagagcaggagatgcatgcggataagcgctatatcccggagattgtcaaccatcttggaaccggcgtggatctgccgcagaagattgcgattgtcggcggcggcccggctggtctttccgcagcgttctactgcagaaagatgggttatccggtaacggtattcgagaaagagtctcgtccgggcggtatgctgttaaacggtattccgtcgttccgtctggagaaaaatatcattgacgcagagatcgaggttctccgccagatgggcgttaccttcaagtgcggcgtagaggtaggaaaagacgtgacgatccagcagctccgcgaggagggctttaaggcattctacgtggcaatcggtgcacagggcggacgcaaggccggagttccgggcgaggacgctgatggcgtgaagaccggtgtggaattcttaagaagcgtgaacctggatgagagcacaaagctttccggaagaaccgtcgttgtcggcggcggtaacgtggcagtcgatgtggcaagagcagcgctgcgcgcaggttccggtgaggtttccatgttctgtctggagtcccgcgacatcatgccggcggcaaaggatgaagtggcagaggctgaggaagagggcatttccgtaaacaattcctggggtccgaaggagattctgacagagaacggaaaagtgaaggcaatcgtcttcaagaagtgtctctccgtcaaggatgcggacggacgtttcaacccgcagtatgatgagaatgatctgatgaccgttgagtgcgagaacgtgctgctttccatcggacagtccatcgtctggggagatctgttaaagggaacaaaagtggagatcagaccgaacggcggagctatcgctgacccggtaacctatcagaccgcagagccggatatctttgtcggcggtgatgtatacacaggaccgcgttttgccatcgatgccattgcagcaggaaaagaaggatttgtatccatgcatcgttttgtcaatccgggacagagcttaacactcggacgtaaccgcagagagttcatcgagctggataagaacaacatcgacgtggagacatttgacaacgcaaaacgccagattccgggcacaaaagccggcgtggcaaaggagacattccgcgacttgcgctgcacactcaccgaggagcagatcaagacagaggcaaagcgctgcctcggctgcggagcttcggttgtggatgagaataagtgtatcggctgtggaatctgtacgacgaagtgtgagtttgatgcgatccatctgacacgtgatctgccggatgcaagccgtatgtggaagtctgaggacaaactgaaagcaattgcaccgtatgcgttaaagcgtcagtttgcgatcaagcgcaacaagaattaagaggagtcatatgcacgaactgggaattattgttcatatcgcaaagacgctggatcaggttgcagcggagaacgaattaaaaaaaataggatctgtcacgttggacatcggtgaggtcagcggtattgtgccggaatatctgacggagtgctgggaattttaccgcaaaaagaatccgctgatcgcagagtgcgagatgaaaattgagtcccttccggcggtcacaatctgtgaggactgtcagaagacctatgagacggttacttacggaagacagtgcccgcattgtggaagctatgaaacgtatcttgtgaccggcaacgaatgcagtatcaaggagatcgaagcctgctaaccggaggcggagagccctataacaatcttaaaatggacatggagggaaagacacggactgtttttccacccatgtccgttttgcgtctgtggaaaagtgacagctaaatggctgcgtgtctgcataaaataagaagaaggagtatggcaggggaggagtttctcgtgccggaaagaaggagaatttgaaaaatctgtatcagggagaccggggaatcctggtatcttacatgcagctggcgttaaagcgcgcggggtatccgcttttggtggacggcatctttggaacgaacacctgccgggcgctcgctgattttttgcagaccgaccgcacgccggaccgcatatgcgtggtggatcgatctgtctgggaaaagctgctgccgtatctgagaggatacgccacggaggagggagagaaccggatcctttttgaagacccggtaacgtcggtggaggtgccttatacgtcgctgctcacagcggcagtgattgacgggcttttggcgcgctacccgtttttaaagagcggggagatcggcaaaagtgtgatgggaaagtcgatttcgtatctggagatcggaaacggggagaaagaggtattctacaacgcatcttttcatgcaaatgagagcatcacaacgccggttctgctcaaatttgcggaggaatatgcgcaggcgtacgaaaaaggaacggcgctctacggcgtgccggcggcggaactgtttgaggagtaccggcttttccttgtgccgctcgtcaatcccgacggggtggatctggtgaacgggctgcttacggacggcgggtattaccggcgggcgcagcagattgcatcggattatccggcaattccgtttccggccggatggaaggcgaatatcgagggcatagatttaaatctacagtttccggcaggctgggaaaacgcaaagagaattaaatatgcgcaggggtacacgaagccggcgcccagagattatgtgggagaggtacccctgacggcgcccgagagcgaggcggtgtacgcgtttaccagatcacatgatttcaggctgatccttgcgtatcacacgcagggggaggtcatctactggaagtatctggactatgaaccggcgcgctcctacgagattgcgcagtattttgggcgtgtcagcggctataccgtggagcagacgcccacgcagtcgggatatgccgggtataaggactggtttatccaggaatacgacagaccgggctacacgatcgagaccgggatgggagaaaatccgcttcccatgtcggatttcgcgggtatctaccgggacaacaccggaattctgctgggcggaatgacgcagatttgacagagaaaaacgcctttcgtataatggagcgtagagtttacattaggagcagaagatgaactataagttatactgggagctgacaaatgagggagacgcgcggctgcttcgggcgtttggcgagacgccggagccgcgtttcccggcagagatagagggaagagcgattacggagatcggggactactgctttgcggcgcaggcgcatctcccggcagaatgccggtgcagttatgtgcaggcggagccgggagcagacggcgcaccggagacagcgccggacggggagatgcaggcggagccgggagcagacggcgcaccggagacagcgccggacggggagatgcaggcggagccggagacagacggcgcaccggagacagacgatgcgcttgcggaactggcgggggcatacataacgcgcgtgacgctgccggagggcataaaaaagatcggaaactttgctttttataatgccacggagctggcggaactggagcttggaagcgggatagacacgctggggagcgatgcatttatgaactgccggagcctgtcgcggctgttactgcatgcggaccccgggcaaaagacggggctcaggcttttgctggcacagctttcgtcggatctggaagtgaccttaagcggcgaaaacggcgtgtgggcgaagctgctgtttccggaatattatgagagctatgacgagatcgcgccggcacatattttcggcagaaatattgtgggggagggattccgggcgagacagagcttccgcgaggacgtgctcgatttcgcacagtacgataagattttcccgcaggcgtgtgtggatgaatcggaggcaacgctgggacggctggcactcgaccgcgtgcgctatgcggcggaactttcggaggcgccgcgcggactttacgaggagtatctgaaggcgcacagcggttatctcatccgccgcatcacggatgaccgggatctggaactggcggaggattgctgcagccggaagtttctgacgcgggaggacgtggcggcgtgtgccatgcgcgcgggggaagcggactgggcggagggagcggcggcgctgcttcatctgatgcagcagtatttcgcggagaaaacgccggacgagtgctattcgtttgacgatttttaagattgtttttacacggaaaagtacgtgcggatgcagggtattttgaaaaagaaaccggaagaggagagatggcatgggacatatacagacacaggaagaatgggaagtgcagatggcggaaaagatactttcttatgtgcgcaacgaactgtacctggaattgcggtatctggacgtcgcattctcggcgcttgtgccgcaggcggatgcgtcgttgcagagctttgccacggacgggggacatctgttctactccacagagcagatactgcgtgtgtttgagaaaaatgcaccgtacctaaaccgtgcctatcttcacacagtgctgcactgtattttctcccatccgtggattgcggggaaccgcgacaggcggctgtggaatctcgcctgtgatgttgctgtggaatatacgattgacggtctgggaaaaaaatgtacgaaacggatcttaagctggacgcgccagaagctgtacgaagaactgcgggaacaaaaaaaaggcgtgtcggctgccgtcgtctacgatcttttgtgggagcgctatttcccgctgccggcggagggaatgccggtctgtgaggaatggcaggcgttagcgcgcgaattttacacggacagtcacaaatattggccgaagagggagaacgatgcggcaaagtgtgcggctgcggcggacaatcagaaaaagtggaatcagatcgccaggcagacccgcatggagcaggagcggcggggagagaagcccaaggacggtgaagaccttttggcggcgcagcttgcggcggggaaaagcagacgaagctaccgggatttcctgcagaaatttgccgtgctgcacgaggaactgcatgccgacccggaggaatttgatctgagttattacacatacggactttcggtatacgggaatctgccgcttatcgagccgcttgagagcagggaggtagagaagatccgcgagtttgtgatcgtgattgacaccagctattccaccagcggtgaactggtcgaacagtttttgcgcgagacggcaaacatcctgcaccagagcgacagtttctttgcgcgttccgtgatccgggttttacagtgcgacaatgcggtgcgaagcgatgcaaagatcacgggtgagcaggagatggaggtgtttcttaagaactttacactccttggcgggggcggcacggattttcgcccggcattttcctatgtcaatgatcttctggaacagggagaattaaaagagctggcgggactgctctattttacggacggaaaggggcggtatccggcaaaacgcccggactaccggactgcgtttctgtttctggaggactatgacgaagcggcggtgccgccgtgggccatgcggcttttgctcgagaaagaggaatttttaaattgaggttgtatttttctgcgaaaggactataatagcagatatggaagcatagctcagccgggatgagcgttcgcctcacacgcgagaggtcacgggttcgagccccgttgcttccactggagagtaccgagagatcggtgctcttttttgcgtaatgggaaacaccgttcctggtattttttcttaagattcctttaaaacgatatgaatttatcgaaaaacgataaaaatatattgcaaaatggaaaaacatggatataataaagctgtgagaaaaatacagcagtaagattgcggaaaagaggtaattatgagtcagaaacaggtggcaggttggttaaaggggatcacactttcgattgcagggatgggactgttgttcttcgggctggtggtgccgtatctggcatgggacatggcggtgacatatccggactacgcggcgctccgcattccggggattctctacgggtggggcattgcggtgttctgctatgccattctctatcagttctggaaggtctgcgtgcagatcggacgcgacaattctttttctggtgagaatgcaaggtcgtttgtggtaatcagcaggctggcgtttgtgctggcggtggtctggtttgcaggaattctgttcctcgcggcaaagcgggcgcttggaccggcatttctgatttttatgattctgctcatttttatcaatgtggtgatcgcggtgcttgcggcggcgctgtcccatctgatctataagtcgtatgagatgaagcaggatgcggagttgacaatataggacggcagcggatcgtccggaaatgaggaagagaatggcaatcaggatcaatatagatgtcatgctggcgaagcggaaaatgagcgtgactgagttatcggaaaaagtcggcattacaatggcgaatatttcgattttaaagaacggaaaggcaaaggcgatccggatggatacgcttgataagatctgccggtcattgggctgtcagccgggagatattctggagtatgtagaggaagaaggggaggagaacggcgatggaagagatcatgatcggtagggaaatgaattcgaaggaaatgattccggaggaagaaaatcaggaaggggcaaagattttcgggaagctggcgggcgccagcctgctctatgcgcttgtatacacgggatgcctgtttgaaaatgtgatgggactggcgtcggtgctttgggtggcgtcgagtgtgtggtatgtacgttttgtgttccgaatgttcggggaaaaggagagacgggacaatggcattgtgctggggatgattgtactgcttggaatctctaccgttctgacgggaaacgaatggatcggctggatgaatgatcttattattttcgtgctgcttgtggggattcttctgcacaacttcgcgcaggataccgggtggaatttcggaaaatatctggcggagattgtggcggcggtgtgcggggcggtctgctttatcgggaagccgtttgcggatggcggagcattttaccgcagcaaaaagacaagggagagccatgcgggctggtatgttctcatcgggatctgcgcggcggtgccctgtctgatggttctggtgctcctgttaatgtctgcggacatggtatttgcagatttgctcgtacggtttgcgggagtgttccggttcccggtgaagctgcttcggattctgctcatgctggtgtttggattcttatcctcctactgcggtgtgcggtatgtacaaaagcacgcggcagacattaagccttccgccggaaaaacagcggaaccgctgatagcgattgcgtttaccgcgccgattgccgtgctgtatcttctgttttcggcaatccagatcgtgtatctttttatcggaaacatgcagcttccggcgggggttacttatgcggagtacgccagacgcggtttttttcagcttctgttcgtatgtgtgctgaatctggcggcggtgcttttcatccagagctattttaaggagaacagagtattgaaggcgctgctccttgccatttcaggctgcacgcttattatgacagcgtcgagcgcctgccggatgcttctctatatccgggcgtaccaactgacgtttctgcgtgtgtcagtgctggtggcactggcggtgattgcacttttgatggctggcgtgatcgcaaagatcgtaaaaccgcagtttccgctgttccggtatggatttgttctggtgggagcggtgtatctcgtattttccttttcgcatgtggattattttatcgccgcttacaatctgacgcacacctcgtgggaagcgtccggggaggagacggtggactacagctatctttacacgctctcgacggatgcggcgccggcaattgaaaaatatgcgggaaaaagcggcgcggcggactacagaaagcagggctggtatcagctgtactgcgaggcgaatgaagaggcattaaatgcgacgggacttcggacatataatgtttcacatgcggttgcaaaacagcttctgatggaagataatagagaatagagaaaaagccgggtgacagcgggcaccggcagaagcggaggagactggaatggaagaacagatggcgagacgccttgtcgcagcggagggaaaaaagctgcagcaggcgggactggtggcgagaacctggggcaatatcagctgccgtatcgacgagaatcattttgtcatcacgccgagcgggctggattatgagacgatgacggcgcgggatctggtgctgatggacataagaaacggtgtgtgctgcggcgcgcataagccttcgagtgaaaagggtgtgcatctggcggcgtatcagatattcccggaggtggggtatgtcattcacacccatcagacctatgccacggcgatcgggctctgcggctttgagcagcttgccatgacggaggaagaggcagagaagctcggcgggatcgcgagagcggcatacgggctttccagtacggagaagcttgcaggggcggtctacgatgccatgcagtcaggagcaaaggtggtctttatggtgcaccacggcgtgctgatctgcggaaaggacagggaggaggcgttttcccgcgccatgctcttagaggagatctgtaagaggagcattttgggacagccgaaaaagaagccgagaaaagaccagaagcgccaggaaaagctgtttcacgtcttacagaagcattttcattatgtgggaatctgcgatacgccggcagtccttctctgcgcggcgagcggacggggaatcccggcgcaggtggatgatatggcgcagatgatcggcaggaagattccgtgctgtcttcatgtgcgcagagatatgcttggactcttaagaaaatacggcgcggtgcttgtgccgcgtgtcggcgttgtggtatccgcgggaacggcggatgatgtggaggcgttaaaggcgcttgtggcaaaggcggcggtctgctgtctgcatgtgcgcgcgacgggcgcgtcggcaacgctctctccggtcaatgtggcgatccagcattatcattatgtgaaaaagtatgccctgcagaaagatggggaagcataagggcaggaggaataagatgaatggaaaacatgccatataccgcgtctatcaggcgctctgcgcggggatgctttccctgtttcctgcgggaagacagacgctggtgcagggggacgggtgtatcaccaggataccggaattattgaagacacacgggataaaaggggtgcaggtcattaccacgccgggaacgatccggcgcgggacggtcgcgccgcttctggcgcagtgtgaggatgccggcatccggacggtgttatacacaggtgtatcgcccgatccgaccgtggcggaggtggaggcggcagcggaatgttttttggtatccggctgtgaggcgatccttgccatcggaggcggctctgtcatagactgcgccaaggtcgcgggagcgcgcgctgtaaagagagatctcccggtcggaaaaatgagcgggatgcttaagatccacaaaaagctgccgctccttcttgcggtgccgacgacggcgggaaccggttcggaggtgacgctggcggctgtcatcacggacgagacatgccactataagcatgccgtcatggattactgtctcataccgcgctacgcatttctcgatccggggcttagctgttccctgccgccggatatgaccgcctatagtgggatggatgcgatgacgcacgcggtggaggcgtactgcaaccggttctgttccccgaaaatgaaagcgcatgccatgaaggcggtgagcctgattggtgccaatctgctgacggcttaccgcgaacctgcgaacaaggcggcacggatgaatatgctgaccggttcctacgaggcggggatcgcgtttaccaatgcctatgtcgggtacgtgcatgcgattgcacatgggatcggcggactctaccatgtcccgcacggggaggcgaatgcgattctgctgccgaaggtgcttgcggcatacgggagtgccgtgtatgagccgctggccaggctggagaggaaagtgcgcgcagcctgggggaagccggagagggaagtgcgcatgtccggagcagagccggagagggaagtgcgaatgtccggagcaggaatggagaggaaagtgtgcgcatccggggcggaggatggaaacagcaaggagacggacgccgtgctggcggaggcgtttattgagagaatccgccggatgaaccggagcatgggcatcccggagcagcttgccatgctgcgcaaggaggacgtgccggaacttgcggcgcgcgcgctcaaagagggcaatccgaactaccccgttcccgtgatctgggaagaggagcagatgcgggcgttcctgatggaacaggtaccaaagtaacagtacagtggacttcccagaaaaatattgcacaaaacagcagtcggattttttacaatttgacggtatacatcatgtacgcaaagaaatacatgcgtttctcttgcaattccatacagataatatataatgtctaagatggttaaaaaattaacgaatagaaaagggcgaggtaaaacacgatgtatgctgatgaaaacgtgatcaaaatcaaacacgacgtactctatgaagtggcaaagctggcatttgccggtgagcttgacgagaagagagacaatatcgcaatgagcctgatcccaggtccgacaccgcagtttcgctgctgtatttataaagaaagagagattatcagacagagagtccgtctggcggagggcaaagcgccaggtctgactgatgacggcaatgtgatccaggtcatcagttctgcatgtgaggactgtccgatttccagttatattgtaacggagaactgccagaactgtcttggaaaggcttgtatcaatgcctgcaaattcggtgcgattgagccgggaagaacccgctcccacatcgatcctacaaaatgtaaagaatgtggaagatgtgcgcaggcctgtccgtacaatgcaatcgcacatctgaagagaccgtgtaagttcagctgtccggtcaacgcgattacatacgatgagcacggtatctccgtcatcgataagaagaaatgtatccgctgcggtaaatgtatccacagctgtccgttcggagcgatcggctccaagagctttattgtagatgtaatcaacgcactgcgcgagggtaagcatgtctatgcgatggctgcaccggcgaccgagggacagttcggggatgacatcacgatggcaagctggaagaatgcgatgaaagaactcggatttaccgatttcttcgacgtaggtctcggcggtgatatgacggcagcttacgagtccgaggagtgggcggaagcttacaaggcgggcgagaagaaagttacctcctgctgtccggcattcgtaaatatggtacgcctgcactatccggatctggcagactgtgtatcgacgacggtatctccgatgtgtgcggtttcccgccttatcaaggcaagagatccggaagccatcacggtatttatcggaccgtgtatcgcaaagaagtctgaggttgtggatcagcagattccgggcaatgcagactatgtactgacctacagtgagatccgtgcgatcatgaaagcgaagagcgtcgtactgcagccggctgcaaacgatgatcagatcgcatccaccttcggtaagcgttttgcaaattccggcggtgtaaccgcagctgttcttcagagtctgaaagagtctgaggatgagatcgatgcaaaggtatgcgttgcaaacggagctgccgagtgtaagaaagcactgcttcttctgaaagcagccagactgccggaggatttcatcgagggtatggcatgcgagggcggctgtgtcggcggaccgagtgcgttcaacgaccagatctcttccaagaagaaccgtgacactctgatttcccaggcagatgaccgtggaattcatgagaacattgagcattacgagatgaacaccatctccatgcacagagagtaacaggatatttgaaatagaaaccgcaagttgccagacaccgcgcgggctgatataatgagttcagcccgcgcggtgttttttttcctttataggataggatgtgcaccatgcggcggggaagagaatgttttgcatatagcagaactgacttttacgcaagagaatgggaattggagagaaaagatgaaaaaagcagtgttttttgatatagacggaaccttgtggaatgagcacatgcaggtgccggaaagtacaacggaagcgatacgcgaacttagggctgacgggaattacgcgtttttgtgcagcggcagaagccggtcgaacatccgcagtgagaagatccttggaatagggtttgacgggattgtggcggcgtgcggcacacatattgaatatgaaggaaagaaggtgtgcgagaggctgcttacgcctgaagaagcggaggaacttctacgtgtcattgaggcataccacatggaagcggtgctggagggaccgcattatatctacgcaaacggggaagattttaaggaagatccgtttatccagtaccttcgcagggaactgggagaggatgtgcgggagatccgcgggcagacggagtatgagatcaacaaattgagcgcttatatgaacggggcgagcgtgcgtgcggtggaagcggagctggtgccgcattttgatgtgattgaacacaatccgcagctgattgaagtggtgccgaagggctacaccaaggcgaccggaatagcgcaggtatgtgacatacttggggttgccagggagaatacgtatgcgttcggcgacagcacgaatgatctggagatgctcacctatgtgggacatggcatcgccatgggaaacggggcatctgcggcgaaggctgccgcggagtatgtgacgaccgatattatgaatcatggaattaaaaacggactgaagcactatgggctgatcggataggaagcaacgggattgcagcgggaagagaaggaggagcgggatggcaaacatgatggattatctggactggcggggggatctgactttcaccgcgtccggatttaacgaggtggataatctgctttttgcggagctggtatatacttcgtttgacgggattgtgaccgggcagagcgaggcggaggcagtcacgcttgcggaggcatccgccgcgttctgggagcagaacagcagggaggagatccttgcgcgggtgtcaatgacaaaggcggcgccgtttgttttggagaagatggcgaaaacagagcgttttcgtgacgtgaagctctggggttacgtcaatgacatcagtgaggaggagcagtcacagtttgcggtcatgtgcgccgggctgccggatggcagtatctatgtgtcgttccgcggcacggacaatacgatcacagggtggagagaggattttaatatgggatacctctcggagacgcccggtcagctgaaagccgctgcgtacgtggaacagatgcttggagatggcagctgccccgtgcgcatcgggggtcactccaagggcggaaatcttgctgtctatgctgcagtccactgcagcagcgggctgcaggaccggattcttgcggtctacagcaacgacggacctgggttccgcagggatattgtagagggcgcggcataccagcgcgtactgccgaaaatccacacgattctgccggaatcttcgattgtcggaatgctcttggagcaccaggaggcgtatgaggtggtgcgcagttccaacagtggaatccagcagcacgatgccatgtcgtgggaggtgctcggcacatcctttgtctatgtcagggaggtggcggcccagagcctgatgttggatgagacgatgaaggcatggatttaccagctgaacggggaggaacgcgaacagattgtggatacggtattcggcatgcttgaagcggcggacattaagacggtggatgatttttaccacagcaaatggaaggcggtgcaggagctgatgaaggcgaaaagccacctgccggagaagagccagaaggtctttgcaaaagccttaaaactcctgtggtcggagggaaataaaactgtccgcaaaacggtgaaacaggtcgttggagagaagcgacggtaagtttctaaaaaaagtataaaatcacaaaaaatggatgaaaatataaaaatacaagaaaacaaaagaaaaaacgagaaaagagcaatataaatgcaaatataccggaatatatccggttgcagatcacatgctaaaaaactattataacactatcggttagcactcaaacgaaatgagtgctaataacaaaacgaaagatattatttcagatcataaaacaggaggtctacaaaatgaaattagtaccattgagtgacagagttgtattaaaacagtgtgaggcagaggagaccacaaagtctggtattattcttaccagcagcgcacaggagaagccgcaggaggcagaggtaatcgccgtaggtcctggcggaatggtagacggcaaggaagttaccatgcaggtaaagaccggacagaaggtcatctattccaaatatgcaggaacagaagtaaagctggatggagaggaatacatcattgtaagacagagcgatattctggctgtcgtagaataagcagctgggaagcatccctgtaatttgaatcagaataagagatagagaggtagatcagtcatggcaaaggaaatcaaatacggaacagaggcaagaacagcattaggagccggcgtagataagctggcaaataccgtcagagtaacactcggaccgaaaggaagaaacgtcgtactcgacaagtcctacggagcaccacttatcaccaacgatggtgtgacgatcgcaaaggagatcgagcttgaggatgcattcgagaacatgggagcacagctcgtcaaggaagttgcaaccaagaccaacgatgttgccggtgacggtaccacaaccgcaaccgtacttgcacaggcaatgatccaggaaggtatgaagaatctggaggcaggcgccaacccgatcgtgcttcgccgcggtatgaagaaggcaacagacaaggcagtggagtccatccttgcaatgtcttccaaagtaaaaggaaaagatcagatcgcaaaagttgcagctatctctgcaggtgacgaggaagtcggcaacatggtagcagatgcgatggagaaggtatctaacgatggcgttatcaccatcgaggagtccaagaccatgcagacagagcttgatctggtagaaggtatgcagtttgaccgtggatatgtatccgcatatatgtgcaccgatatggataaaatggaagcggttctggatgatccgtatatcttaatcacagataagaagatcagcaacattcaggagatcctgccgttattagagcagatcgtacagagcggcgcaagacttctcatcatcgctgaggacatcgagggcgaggcacttacaacattgatcgtcaacaaactgcgtggtactttcaatgtagtggcagtcaaggctccgggctacggcgatagaagaaaggcaatgctcgaggatatcgcaatcttaaccggcggtcaggttatcagctccgatctcggattagagcttaaggataccacaatggatcagctcggacgtgcaaaatccgttaaagttcagaaggagaacacggtaatcgtggacggtgcaggcaataaggacgctattcaggcgagaatccaccagatccgcggtcagatcgaggagacaacttccgagttcgacaaggagaagttacaggagcgtcttgcaaagcttgcaggcggcgtagcagtgatccgtgtcggcgcagcaactgagacggagatgaaggaagcaaagcttcgtatggaagatgcgttaaacgcaacgagagcagcagtcgaggaaggcatcattgcaggaggcggttccgcatacattcatgcaaccaaggatgtggcagcactcgcagatacgcttgagggcgatgagaagaccggtgcgaaggttatcttaaaggcattggaggctccgctgtactacatttccgcaaatgcaggattagagggcgcagtcatcatcaataaagtaaaagaatctccggcaggcgttggatttaacgcagcaacggagcagtatgtagacatggtagagcagggtatcctggatccggttaaggtgacaagaaccgcattacagaacgcaacttctgtagcatctaccttacttaccacagagtctgtggtggcaaacatcaaagaggacgcaccggcaatgccggcaggcggcgcaggcggaatgggaatgatgtaaatcccatccgaagagggaatccatcccggtcaatcgaccggggtggattttttttctgcaattagaaaactgtgttcttattacagaaaatgtttaaaataaaaatatttgaaaaatattgcgataattgcaaaaagggaatataattcaagaaaagtgaagcggcacggaggaaatgcgtatgaagatccttgcgacatttgatgcccgtgattatgagggcacgacgggtatctatgaaaagtattcgatacgggcgatcattgtgcgtgacggcaggcttgccatgcagtgcagccaggagggagaatataagatccccggaggcgggcaggagccgggtgagaattatgagcagacgctgatccgtgaagtaaaagaggagacaggactttatgtcaggccggagagtatctgtgagctgggcgagataatagaactgcacagagatatttttgagccggataaaaagtttatctgccattctctttttttttactgcgatgttttggacgagcaggcgccactttcacttaccccgagtgagattgcaaaggggtatcagttaaaatgggcgacgccggaggaagtctatcacaggaatattctgattgagaaagattcctggattatccgggatacggcgtttgtgaagatgctgatggatggaaagatctgtctgcccgggtgagatcttacaaaggaagggattgttatgaaattaaaacaaaaacaaagattggaacgcaacaagattacattcatccttggacttatcatccttgggcttttgaatgcactgacactgcttggatttgtggatgcaacagcggataaatctgttgtgctggcacgcatggtagtcaatgtcattcttctcgtgatattttttgttggacatgtccggtatcgcggggataggaaatttgttatgatttcactttcgtgtatgtttcttacctatgcagtgatgatcttatcaaacaaaaacgtggtcttttatgcatttatgtatttaattatgcttacggttatgttgtatcgtgatataaggctggcacgcatcagcgctattgcgatgggagcgctgaatgtaatttcgggcatacttcattttgtgaaatatcctgggacacggagcgagtcagttgtacagatagtgtttgccatttctttcggtgttgtgatgtgtattgcggtagatctgcaggcgagacaccatgttgaggatacagatgccattaagtcacagatggatgcggcggcgcgtgtggcggatgagatcattcagatgtcgggagcgctgtccgagaagttcgacagtgcgagagagaaagcggatgtgctgacggagagcatggtcagcagcaacaactccgtcaaggagattgcatcgagcgtcaagctgacggcggaagcgattgagcagcagacgatgcagacgaacggcatccagacgaatattgaaaacgccgaaaaagagacgaaagagatgcagacggcgtcagatgcgacacaggacgcgctccgtgagggcgctgacctgatcgccgagctgaaggagcaggcaacccagacggcggagatcaaccgcgccacaagaaccacgacggaagaactggacaaccgcataaaggaagtggaggtcattatcggaacgattttaagcatttccgatcagaccaatctgcttgcactcaatgcgtccattgaggcagccagagcaggggaggctggaaaaggctttgcggttgtggcagacgagatccgcaagctttcagaggagacgaaggagtcgacgggaaagatcacggagattatcgaaaaattgacggtaaatgtggaggaagcctctgtaaatatgcagaagtcagcggagtctgcagataagcagaacgagatgatcgagacaacgagagagaagtttactgttatcgaggataagatgaatttgttccagaattctatgcagaatttgtctggtgaggtggagagtatcctttcagcaaatacgcagatcaatgacagtattaccaatttatctgcaacgagtgaagaggttgcggcatcctcagaaaacagcatgtctatgagtgaggatagtatgcagaatatggagaatctgaatgatctgcttggcgaaatttacaagatttcggagagaatgcgtgaggttgtagcacaggaacaggcgtgatgcggtatacaaaagtatacatgtagaatgaatagaagagtcattttagcgtttttaataatagaaagcgtgctacggtgcgctttctattattttttggtggcggtccgggacaaaatatggtacaatgcattagaaaaatgataaggggggatccagagattatgagtgaagattttattacaatgacaataggaaaacaaaagaatattgcactgattgcgcatgacaataaaaaagcagatctgattgactggtgtgagcagaacaaggagattttaaagcagcattttctatgtggcacaggtacgacagcacgtatgattacggatcagacaggactcccggtaagaggctataacagtggccctctcggcggagaccagcagattggcgcaaagattgtggagggaagagtggattttgtgattttcttctctgacccgctgacagcacagccgcatgacccggatgtgaaagcgcttttgcgtatcgcgcaggtgtatgacatcccgatcgccaacaaccgggcgtcggcagattttatgattcattccacttatatgaatactgagtatgagcatgagatcatcaattttaagaagaacatcaaggaacgatcagagacattgtaagggagagtagaagttatgagcaaagtagcaatcgtatctgacagcaacagcggaattacgcaattgcaggcggaagaacttggaatcaccattctgccgatgcctttttttgtgggagacaagacattatatgaggacattgatctgtcacagaaagagttttatcagatgctgtccgagaatgccaatatttccacatcgatgccgcttgtcgggaatgtgacagatacatgggatgcattgctgaaggagtatgatgagattgtgcatattccgatgtcatccggcctcagcggctcctgtgagacggcgttgatgctggcgcaggattacgagggaaaggtgcaggttgtgaataaccagagaatctctgtgacgcagcggcagtctgtgctggatgcgatggcgttggcagagcagggacgcagtgcagtggagattaaggagattctggagagagataaatttgagtcttccatttatattatggtggataccctgtattatctgaagaagggcggacgtatcacgccggcggcggcagcgcttggaacgttgttaaagttaaagccggtactgcagatccagggagagaagctggatgcatttgccaaggcgagaactgtcaagcaggcgaagaacctgatgatcgaggcgatgaagcacgattttgcggagcggttccatgatccggaaggaaagagtatgcatctggagatggcgtacacgtacgatctggatgctgcggaagcgttcaggcaggaggtgcaggaagcatttccgggactggagattcatatggatccgctgtcactgagcgtatcatgtcatattggaccgggggcacttgctgttgcctgctcgaaggagattccggagctggaagcgtagataaaataaaacaggacaatataaaagaccgtattccgggatgacggagtacggtctttttgatgcaataggatgcatttccgtgtgagggaaaaatgtttacgccgccttggaacactgcttcatccggtgctcccagagaagataggtgataaacagcgggatgccggcaccggcccaggcagccggatcagcgaagcagacaccgaagaagccggtgctcgccggaacgagagcgatgacgccgaagcggcaggcgagctcgacgacaccggagagcatggggatcagtccttgatccaggccctgtaaggcattgcggtataaaaagatcatggcgagcgggagaaagaaccagcttgcgatcgtcaggtactgcatggcggaagagaagatctcctcggaaggattgctcacgaaccagctcacaataaaacgtccgccaaagatgcagatcgcggcggctgtggctgccgcaccgaagcagaggagaagtccctgccgcatgccggcgtagatgcggtcgtatttgccggcaccgaggttctgtccgcagtaggttgccattgcggtgccgagtgtcggcatggactgggtcgcgatattgctgaccttggaggccgcggtgaaggcggcgaccacactcgagccaaacacgttgaccgcactctgcataatcatggtgccaatggcggtaattgagtagttgagcgccatcggcacaccgatggcgagcatgttttttacgccggcggaatccagataataatcctcatgtctggtgcgcaggatatcgtatttccggtacatataaaagaagcagagcacggcggagactccctgtgcgatgattgtcgcgtaggcggctcctgcggttccaagccctgtgtacacgatcagtacgacatctaagatgatgttgagcacggacgagagaatcaggaagtagagaggagtgcggctgtcgccgatgccgcgcaggatgccggataacacgttgtacgccattgtcagcagaatgcccgcaaaaattaccttaatataagcgtctgccatggcaataatattttccggtgtgtgcatccatgccagaaggaggcgggaagctgtcaccgttgggatggtcagcagaagcgatataatcagtgtaagaatcagggagagcgccacgtagtgacggagcagcttaaaatctttggctccgaaagcgtgtgaaaccatgacgccgaagccctgggcgatgccgttggcaaaaccgagcacaagaaacatcaggcagccggttgagccgacggcggcgagagcctcctcgccgagatagcgtccgacaataatcgtatctaccatattatagaactgctggaacagattgccgagcagaaccggaatagaaaatagcaggataatccgaagcgggctgccggtggtcatatctttggtcattggattgcgtctcccttcatagtctgttatagtagagatactggtactttgcgtaaggcatagtatacttcatgacagtggaaaatacaatccgtttttgtaaaaaaaatgagacttttttcccaggagagatccatggacatcaatctggaatattataaaattttttattatgtggcaggctcccagagcatcacattagcggcggagcagcttaccatctcgcagcctgcagtcagccaggcggtgaagcatttagagcaggcgctttcgtgcccactgtttgtgcggacgaccaagggcgtgcggctgaccaaggagggagagatgctctattcctatgtgcagcgcggctatgaaacgatcctctcgggcgagaggaagctctctgagatgctgaatctggaacagggcgaaatctgtatcggtgccagcgacatgacgttaaagtatttcctgcttccgtatctggaagaatttcatgagcgctacccgggaatccgtgtgacggtgacgaatgcgccgactccggagacgatccgccatctctgcgacggccgcattgattttggcatcgtgagcacaccggtcgagaagagagcttcgctcaaatgtattccggtgaaggagatccgggatgtgtttgtggcaggcaggaagtttgaatatttaaaggagcgcatgctggggtacgaggaactgatgaagctgccggtcatgtgtctggagggaaatacctcgaccaggacgtatgtagagcaattccttgcgtcgaagcaggtgacgatccggccggagtttgaacttgccaccagcgatatgctgatccagtttgcggtgcgcaaccttggaattgcaagtgtggtcagaaattttgccgaggagcacctgacggagggagatctgtttgaactgcggttcttggaggagataccggcgcgtacgttctgcattgttgcaaatgaacggattccgctgtccgccgcagcggctacgctgatgaatgttctggtacaggggacatcacagtaagcagggattttcttttagaaacaggcataataaatacttatgccacatataatgaatattgattttacttatacaaaaggttcgtgtataatcaataagtaaaaaggcggaagtgagtgacggttttttacaaccgtcactttttatgtcatgaggcagatttacagagtggatgctgctttcggacagaccggccgcatggatgcagcctggaatcaggaaaatgcggacttccggcaaaaaagtgtatcatatcaggaggaaaaacatatggttacagcagtagtaggcgctaactggggcgatgagggaaaaggcaagatcacagatatgctcgcggatgaggctgacatcgtcatccgttttcagggcggagcaaatgcaggacacaccattgtgaacaattatggcaagtttgcactgcacacattgccgtccggcgtattccacagccatatcacaaatattatcggaaacggtgtcgcactcgacatcccgaaggtaatcggcgagctcaagtcgatcacagaccgcaacgtaccggcaccgaagctgatgatctcggacagagcacagatggttatgccgtatcatgtcctgttcgaccagtacgaggaggagcgtctcggcaagaattctttcggttccacaaagtcaggaatcgcaccgttctattcggacaagtatgcaaagatcggtttccaggtcagcgagctgttcgatgaggagctcttaaaagaaaaggtaaagcgcacctgcgagacgaagaacatcatgctggagcatatgtatcataagccgttattaaaggaagaggaacttcttgcaaccttgcatgagtacagggatatggttgctccgtatgtcggggatgtctccttattcctcgatcaggcaatcaaagacggcaagcgtattctgctggagggacagcttggaactttaaaggatccggatcacggaatctatccgatggtaacatcctcctccacgctggcagcttacggtgcgatcggagcaggcatcccgccgtatgagatcaagaagatcgtaacggtgtgcaaggcttattcttccgcagtcggagcaggcgcatttgtcagcgagattttcggggatgaggcagacgagctcagaagacgcggcggcgacggcggagaattcggcgcaacgacaggtcgtccgagacgtatgggatggttcgactgtgtggcaagtaagtacggctgccgtatgcagggaacaaccgacgttgcatttaccgtgctcgatgtattgggatacttggatgagattccggtatgcgtaggctatgagatcgacggtgaagtgacaacagatttcccggtaacagcaaagcttgaaaaggcaaagccggtacttaagaagcttccgggctggaagtgcgatatccgcggcatcaagaaatacgaagatctgccggagaactgcagaaagtatgtagagtttgtggaggagcagatcggatatccaatcacgatggtatcaaacggaccgggcagagaggatattatctaccgcagcaagtaggatgacgcatatgattaagaatgtcatttttgatgtgggacaggttctggtggcatgggaaccggtggaggcgatgcgcgcgcttggaatggatgaagagacggtgcgcgcagtcgcagatgccacggtgcacaccagtgactgggacgaggcggaccggggagccctgtccgatgaggaacttctcacaggctttatcagaaaagctccggcatacgaagcacagatccgcaatttctgggagcatgtggaccgggcgatttatccgtttccgtatgtcggggaatggatgcggacgttaaaagacaaggggtatcgcctgtatatcctttccaattacggtgcctggacatacgcgaagacgaaggatcagtcgcttggcttccttaaggacgtggatggagcattgttttccttcgaggtgaagcagattaagccggagccggagatttatcactccctgcttgagcgctttcatctgcgcgcggaggagtgcgtgttcctcgacgacagacagaacaatgtggacggtgccatcgcctgcggcatctctgccattcgttttaccggctacgaggacgccagacagaaattaaaagaatacggtgtagagtgctagaaagggaactgtcgcaagaagcatatcgtgctttgggctgataagtaatatcattagaagatcacatcgtgggatttcagatgaaaatgcagatggacattcggttcaaaaaatgtggcatttctaaccagccgaatgtttgcatcttcgatgatccgtgtttttccaagtttggagcactccgcgggtcatgtccgcatcccggaagacaatttgtaggacttttgtgtgtgtcccttatggcacctctgaacaaaacataaccgcgcgaagccgctgtctgagtcggcatctgccctatttttaatagcagatgccggcgagttcggttcgcgcggttttatattgtctgtgaagaggtgccattagggacaccagaaagtccgcccattgtctccggtgtgtcggacatgcacccgtcggattgtccaaacgtggaagagacacggaatccgatgcaaacattcagcaggaagaaatgctcacatttttctcaaacgaatattccatctgcatttccacatgaaatccccaagtgtgtttcttataatattacttatcaccccaaagaggtctatgcttattgcaacaattcctttgggtttgttttcacagaattatcacagaatgattcccttttgaacacatttctttcgtaggctagatacggaaacaggaaaaaggaggaaatggttttgattgaaatcaatcatctggtcaaaaaatatggggaacatgtggcggtggatgatctgacgcttacggtggaacccgggaaaatctatggttttctcggaccgaatggtgccggaaaatccacgacaatgaatatgattacaggataccttggcgcgacgagcggcgaggtgaagatcaacggtcacgatatttttgtcgatccgcaggaggcaaaaaaatgcgtggggtatttgccggagataccgccgctctatacggagatgacggtgcgggagtatctggatttcgtggcagagctgaaaggtctggataaaaaggtaagaaaaacacagacagaagagattatggagctgacacacacgaaggaagtgagtgagaggctgatccgcaatctctccaaaggatatcggcagcgcgtcggctttgcacaggcaatcatggggtatccggatgtcattatactggatgaacccacggtgggactggacccgaagcagatcatcgaagtgcgtgaactgattaaggagctcgggaaaaagcacaccgtgattttgagttcccatattctgacagagatttcggcggtctgcgatcatgtgtttatcctgtcgaagggaaaacttgtggcgagcgattcgacggaacatctgctggagcggatgtcgggagcacaggaaatcgcgcttctggtaaaagacaaagagcagcgcatggaggaacttttaaaggaacttccgggtgtggcggaagtgagcagagagccgggagaagcagcggaggaagtcctgtttcatgtgacggcggagcggggcgaagatatccgtgaggcattgtttcatgcctgcgcaaaagaagagattccggttctggaaatgcacacggagacaaaatcgctggaggatgttttccttgaacttacaggagcagacgggaaaggagaacaggcatgattgcaattttaaaaagagagtggaaaagttattttcagaatatcacaggatggctgtttatcgctgccgttctggcactgtacggtctgtactttttagcgtataatctgcgggcgggatatccgtatgtgtcgtacacactttcggcgatctcgtttatcatgttgattgccgttccgattctcaccatgcgttccatggcggaagagcggcacagcagaactgaccagctggtactcacagcgccggtttcgcttggaaagatgatttttggaaaatttttagccatggtgggcgtttttaccgttgccgtggcggtgattgcggtaacgccacttgtcctggctgcctttggcacggtgccgatgggagaaaactatgtggcggttttgggcttctggctgtacggatgtacctgcatcgcagtcggtatgctggcgtcggcgctgacggagagtcaggtaattgcagcggtcgtggcgtttgcattcctttttctgggatatatgatgaacagcatcacgggattgatcggcgaccatctgatcacgaaggtactgggcgcatatgatctgtacacaccgcttcagagttttatgagcggctgtctggatctgacgggcgttgtgtattttgtcagtgtgacggcattgtgtctgtttttgacctgccagtgtgtgcagaagagacgctggagcatgacgacgaaaaaactgaccacaggaatgttttccgtggcgatgattgtggtgggatttgcggttgcggttgcagtcaacatggtggtaaaggagatgccatcctcctggacggcggtagatgcaacttccacaaagctgtacagtctgacggataccacaaaggattatgtgaaaaatctgtcgcaggacgtcacgatctatgtgctttcgtccgagaagtcggcggacagtacgttggcggagacattgcagcggtatgaagatctctccaaacatttaaatgtggtttacaaagatccggcgaagagtccgaatttttatcagcagtatacggacagtgcgccgagccagaacagtatgatcgtggtgtcggacgcgagatcgcgcgtggtggattacagcgacatctatgaatattcttatgactattctacatattcaagctctgtggacggttatgatgcggagggacagctgaccagcgccctgcagtatgtgacgaaggcagacagtgaacttccggtcatctacgagattaccggtcatggagaaaataccctttctggcggtttctcggaggcggttgagaaagccaatatgacggtgtcacagctgacattgctgacggaagatgcgattccagacgatgcagcggcaatcgtcatcaacggaccgacatcagacttttcggaggatgatgccacgaaggtaaaggagtatctgcaaggcggaggaagagcgctcatcgcctgcaacttcgagtatcaggatctgccgaattttgcttcggttctggaggcgtacggcattgaacgggtagctggcattgtgatggaaaacagtgcatcagcatgctaccggagtaccccgtattatctgttgccggaaattgagtcgacagcctatacttcatctgtgacgggcgagtacattttcgcgccgtacagcgagggactgagttatccggaggaagcggaagatattacctacacaccgctgcttgtcacaagcgatcaggcggtgtccaagacggatgtggcaaatgcggagacgtctgagctggaagacggggacattgcaggaccgtttacgattgcgctggcggcagagcaggatgtggatgacggcaacacgatgaaactggtggtgtttggctccacggaaatgctgaccgacaatgcggactcgattgtatcgggaagaaatgtgtccatgttctcagatgcgttaggacagcttgccggtgacgacggagagtcgacgggcgtcattccggtcaaggagtatacgcttggaacgattacggttacgtcactcggaacgctgatcggcggacttgcggcaacggttatcctgccgattctgctgattgtgaccggtgttgtgatctgggcggtaaggagaaagaaataatgaagaaacagaaaaaacagttctttggcatgctgcttgtcctcgcagtgcttgcagcagcctatggaggaattcatgtatacaatcagaaacaggaggaaaaagaggcgggcgaggagaaaacagagaaacttacagttgtcgattttgaaaccgatgatgtgacggcattctcgtacgtgctgggcggtcaggtgtatgcctacacgaaaacggacggagagtggacctgggacggggatatttcactcaccctcgacacgtcacagatcgacgccatgctggatgcggtcacgggccttacggcggagagtgagattacagacggcgaggatctggcgcagtatggtctggaaaatccgtcggggatcattaccctcaccacggcagacggcacgacgacgctacagctcggagataaaaatgcagtgaccgggcagtattacctgaaggtggcagagagcgataagatctatctcgtgtcgcgggatctctccggcactttctccaagacaccgcaggaattgttaaaggaggaagagacggatgagcctgagagtgtggacgtgactgagggcgtagaggcggctgtgggcgtagacgtgaccgagagcgccgcgtccgaggacagtacggaagagtagaggacggatcaaaagagccactgcacgggcagggagatggactccgtaataagagaaaaacgatagatgttccagatacaaaggatgcggacattctaaacacaaaatgcggaatttctaaccctgcccgccgaaacatccctgatgatccatgtcttttcaagcttggagcactctacagggtgtgtccgcaagccggcagacaattttaggactttcgtgtgtccctttggacaccgctgaacaaaacataaccgcgcgaagccgctgtctgagtcggcatctgccctgtgttcaatagcagatgccggcgagttcggttcgcacggttttatattgactgtgaagcggtgcccattagggacactagaaagtccgctcattgtctgcggttgccggacacaccctgtggattgtccaagcgtgacaaagacacggaattcgatgtcccggcgggcagggaagaaattctctcattttgtttcaaagaatccccgcatccgtttgtattctggaacattctgtcggtttttctcttatcctgaaatttgtatctattttccctgcccctgcggcggctccttttgctcggcgtcctcttcggacgacttgtgcacgagcttatagatgagcgtgtacgcccacagcagaaccggaatgatgacggtcgcgtagatggagaccatcagcagattcataaaattctcgctggaacttaaagcgcagacgagcgtggatgcatacagcaaaagcagaagaatggcgccggctgcggcaagaatacgtttcacttttttcatggtaacctcatttctaaacagccttctggtttacggctgtacctttatggtagatggaaaaggcggttccgtcaagcagaaaaaatttacacgaattgtacaaactttataaaaaccatataaagtttactgaaaacacaaaaaatattacaggaatttgatagctgcctcccggtggaactcttacaataaggactgttgagtttgcaatgtaagagagcactgggaggttttattttggctgaattggcgttagaacatgtgggaaaagtataccggaacggttatgaagcaattcatgacttttcgcttgagataaaagaaggagaatttttgattctggttggaccgtccggctgcgggaaatcgacgctgctgcgcatgatcgcaggtttggaggacatctcgtcgggcgagctgtgggtggacggagagatcgagaattacaaggagccgcgggagcggaatctcgccatggtatttcagaattatgcgctgtatcccaatatgagcgtgtacgacaatatcgcattttccctgagcgtgaggaaggtcgataagaaggagataaaaaagaaagtatacgatacggcaaagatgcttggcattgagcatctgctggacagaagaccgggagaactctccggcgggcagaaacagcgcgtggcgatcggaaatgcgattatccgcaatccaagggcgcttttgatggacgagccgctgtccaatctggatgcgaaactgcggacgcagatgcgggtggaactggcggcattgcagcatgcggtgggaacaacgacgatctatgttacgcacgatcagacggaggccatgacgcttggcacacggattgtggtgatgcgggatggaaaaatgcagcaggtggatacaccggcgaacctctatgcaaagccggtcaaccggtttgtcgcaggattcatcggaacgccgtccatgaactttttcgaggcacaggtggtttcctgggaggaggctccggcgcttctggtcggggagtaccgcatgatgccgtgcagggaggatgcagcgcggataagcagacacggaagcgacagcgtgatccttggcatacgcccggaaaacatcctgtgggaggcaccggaatgtgtaagcgccggggcggattacgtggagacgatgattcttgaggtggagctgctcggagccgagaagcttttgtttttccttttatacgggaaaaagtatgtggcaaagattccggcggaatatgacgcccgggcaggtgaggtgcgccggctgtacttcgatgtgacagcgatccatctgtttgactgcgacagtgaaatgcgcatctgaaaggagacaacatgaatgcatttgtaaagctaagacaaaagatcagcccgtacctgtttttggtgccgtgtcttatcgtattcggactgttcttatgtatgcgctttccattgcgtttatgccatccggggaattgttctcgatggagatgaatctgattccgaagcagccgacgcttgacaattttgcacaggcgtttacaaagattccgctgtttcgttttattttaaattcgtttctggtggcgggatgcattacgctcggacagattatttcctgctcccttgcggcgtttgcactgtcatttctggactttaagggaaaaaatgtgatttttatgctgatcatggcgacgatgatggtgccgggagaagcgacgattatttccaattatttaacggtaagcggatggggctggctgaattcctacaaagtgctcatcattccatatatcacttccgccatggggatctttttgttccgtcagttctatctgacctttccaaaatccctgtatgaggcggcaaagatcgacggctgtccgaatctggtgttcattgtccggattctgatccctctgacgaagtcggcgatcggagcgatggcggtctataccttcatcaacgcttacaacatgtatatgtggccgttgttagtaaccggaaccgaggagatgcgaaccgtgcagattggtatcagcatgttaaacagtgtggattcccagtcgattacgatggtaatcgcgggagttgtgatggtgattctgccgtcgctgtttgtgtttattctaggacaaaagcaactgatccgcggtatgttttccggtgccgtcaagggctgacatagaaaaaaggaactcactaattcaaaaggagaaaaaagaggaatgaagaagagaatcattgcatcattgttaacagcatccatgcttgcagcagcacttgcaggctgcgggggaagcacggcgcagacggcggatacgtccgcagacgctgcaggggaagcggagagtgcgcagggtgatccggcaacggtgacggaaaaagagacgaatgtgtccgccacggcagatgcggatctttccgggacgacgatcacattctggcattctatgagcggtgtaaatggcgaggcacttaccgcgcttgtggatcggttcaatgaggagaacacctatggcattacggtggatgcggagtttgagggcgagtacgatgatgcgatcaacaaattaaagagcagcatggtgggaggaagcggtccggatctgattcaggtctatgagatcggcacccgtttcatgatcgactccggctgggtgattccgatgcaggagctgatggatgcgaacggctatgacaactccaatatcgtgccgaatattgccgcttactacacgatcgacgaccagctctactccatgccgtttaatacatccacgccgattctctattacaataaggatatgtttgatgcggcgggaatcaccgaggtgccgacgagcctggaggggatcgatgcgattgccgacgatcttgtgaacaagggcggtgcaggagaggcactttccatgggaatctacggatggttctttgagcagtttatctgcaagcagggactggcctacgcaaacaatgacaacggaagaagcgcggcggcgacagccgtggattttgacggcaacggtgcggctctctcgatcgtatccgcctggaaggatctctacgacaagggatatgcaccgaatgtgggagttggcggcgatgcaggtctgacagacttctccgcaggaaaagcggcgattacgcttggctccaccgcttccttaaagcagatcttaaacgatgtcaacggctcctttgaggtgggaaccgcatattttccgggcatcaaggatacagatcagggcggtgtgtccatcggcggagcatccctctgggcaatccagaatcaggatgacgtaaaggcacaggcaacctggaagttcgtggaatatctggtatcggcagagtctcaggcatactgggcaacccagacaggatatttcccggttaccaacgatgcgtacaatgaggatgtattcaagcagaacatcgagcagtacccacagttccagaccgcgatcgaccagttgaacgacaccaagggcgagtacgcgggagcgcttctctctgtatttccggaagcacgccagacggtacagaccgagatcgagaacacgttaaatgacaaggagacaccggaggaggcagtgcagaagatggcggacacgatcaacgcgtccatcgaggactacaatctgctgaacgaatagttttttagtggcaggcaatagggtaagcgacacatcccaccgatttcagatggaaatgcagatgaaacattttttgatccgaatttccagatacattccctctgaaatcgaagggcatgatcttctcaccctattgcctgccacgtcaaaatgaacgatctgcttccgtcgacgtcctgttgcttttggcgggttctgtaaaaaagtctttgaaatatgccggaaaatttgttataatactatagtgcatctttgacatagcagatgtcggacaagcaatccggcagacagatgcaaataatcatgaaatcgaggaatcagatatggcattattagagcagtggcagaaagttgcttataatgagaaggcagacagaggagaactgcagagattctggcagagatattttcttctggaaaagggtgtctatgagaagcttctgacgaacccggatgagaaggtagagggaacggtcaaagagcttgcagataaatacggactgagcatcatggatatgacaggtttcttggacggtatcaacgagagcctggtagagccgaacccgatcgacaccatggaggaagatacgaaggtcagcctcgtattcgacaaggagaagctgtacaagaacatggtcgacgcgaaggcagactggctctatgagcttccgatgtggaatgacatttttgacccggagacgaagaagagactgtatctggagcagaagaagtccggaacggttatcgtcggaaagaaagtcggacgcaacgatccgtgtccgtgcggttccggcaagaaatacaaattttgctgtggaaagtaagcacaggaagcagagtgcaagggaagtaccggtatgtggtacttccttttttgtgtaataggcaaattcttcctgctgtggaaaaagaaaaccggttataaaagaaattgctccggagatacttaagaatgggaatgtatcattccagagaacaaggatcgaaaggagaaaagagatatgacattactggattgtgcggtaaccggatgtgcttacaacgaggatcgctgctgctgcaagggcaacatcaaggttgagggaagcgaggcggtgcatcagaatgagacctgctgcggaagctttgtggagcgcggggagaaaagctgcggatgcaatgtaaaagagcatgagtcaaagaagatcgctgtggcatgcgaggcctgcaactgcacgtttaacgagaataagaaatgcagcgcgaaccatatcggcatcgcagggggcaacgcctgttcctgcggcgagacagagtgcgcaagtttctgctgcaaataggagaaaagacggggagccggaggcaatgcaaaacggttccccgttttgcattccggtcattaggctttagcctgctgaatgcgtgtttacgagtttctcaacagagaaacgaagtacgcatgaagcaaaaacccacctgctatgcgggtggagtcaaatcgttatacagaaaaacacctttccgttacaatagagttgttcagtcactattgcaagaaaggaaaggtgttttatggcgaataagtctaatgatctcgcccatacaaaatggatgtgtaaataccatattgtatttactcctaagtatagacgaaaaattatttataatcaattaaaagaggatatacgtgatattctgaaacagttatgtgcatataagggcgtggagattattgaagggcatctcatgcctgaccatattcatatgctagtaagtattccgccaaagatgagcgtgtcgagttttatgggatatttaaagggaaagtcagcgcttatgatttttgacagacatgcaaatctcaaatataaatttggaaacagacatttctggtcagagggatattatgtcagcaccgtaggattaaatgaaacgacaataaaaaagtatattcaagatcaagaaaagtacgatattatgcaagataaattaagtgtgaaggagtacgaagacccttttaagggttaagtcgaagtagtacaaacgcccattcatgggcataagcaacgcgtcaagtgcaatagtgacttgaacgaagagaaagtctagggcgccttgagacgctgtcgggtaccaaggggttacacccagcgtcccgagccaccctttttaagggtggcggcgactggaattttcctcttgtaaagtgcgtctgatggaagtacaatgaaagcaaaattaggaaaaaagtcatgcagtgcagaagggggaaccgatgaatgagaaaaaagtcacatatttcgctggcgcgctatatggtggagaatttaaaggatgaagaattaaaacgtcacaaattttctttttatctgggaagtattctgccggacatcaagccttcgtttctctataagagacacgagatggacggaacgtttccttatgtcagcagacatatcaggcgtctgtcggagggagatgcgctgatccggaagaaaaaggggtgcaagtattaccgggatctgggacagatcagccattatctggcggattattttacatttccgcacaacaccatttacccgggcagcctgaaggatcattgttcttacgaggagaagttaaagcgggacttaagatcgtacctaaagagcggtgaggctaccagacatcaccggctgctgcagcttaaggaagaacatgagaagctgcagaataagaaaaaggcagagccgctcatcgacgcggagacgatctgtgcttttatccagaagtcgcatgacgagtatctggcgcacaagcatggcgtggaggatgatatagaacatattgtcgaggtgaatcacaaagcgctggatgcaatgatgaagttattggcgaataaacgcgccgagtggagaatccggcactcataatgtcgaaaaatgacgggttgttttcgttgattttcgtgttcggacatagtaatataatgaatgtaaggcaggcagtgaagagcagatttatgtgggaatgcccacctttagtgctatgttaacgtcagacataggaatcttagcgttttaaggaggattcatatgaatagaatctatgagttacaaaagaagatcgagacggcgagacacgagttggatgaagcactgttgcaggagaacaggtttgagtactattacgagaaaagcaccagactggacaagctgatagaagaatatcttgagagtcaggagggtgtcagggtctgacaattgaataaacacagtaaacaggacggaacatatatgcgaggcatgtatgcgaggtcctttttttatgcccaaacgcaagttttgggcttttttctattgcaatttggtacaaggtggggtaatattatcatacaagtggaggaaagtggtggagaatggtacaaagtggtggataagttcataactttgtggaaaaccactgaaggcaggtgtttgtgttatgttcatgggagaatacaatcacacagtggacccaaagggcagactgatcgttccatccaaattcagagagcagttaggcagtgaatttgtggttaccaagggactggatggatgcttatttgtgtaccctgccgaagagtggcacaatattgaggagaagttccgcaatatttccatgacatcgaaggatgccagaaagttttcccgttttttctttgctggggcggccgcagtggagctggacaagcagggcagaattctgcttccgccggttttgcgcgaatatgccaatttacaaaaagatgtggtgctcgtgggagtcttaagccgcgtggagatctgggataaggacagatggcaggagaatacctacgatgaggatgagatggacgagatcgcagagcacatggcggatcttggattcagtatctaagcaggaggcgcaggttggagtttaaacattattccgttctactggaagagacaattgaacatctgaacatcagaccggacggaatctatgtggacggaacgcttggcggtgccggacatgccagtgaagtggcaaaacggttatcggaaaagggacgtctcatcggcatcgatcaggatgcggatgcaatccgggctgcgggagagcgtttgaagccgttcggcgataaggttacgatcatccggagcaattacgccaacatgaaagaggaacttcatgcgatcggtatagagcatgtggacggcatcgtgctggatctgggcgtgtcatcgttccagcttgacacaccggagcggggatttacctaccgggacgccgatgcgccgcttgatatgcgcatggatgacagacagagtcttacggcaagggatattgtcaatgactacagcgagatggatctctataggatcatccgcgattacggtgaagataaatttgcaaaaaatattgcaaaacatatagtgaacgagagacagaagaagccgattacaacggcgggggaactgtcggaaattattcgggagtccatcccgatgaaagtgcagaagaccggaggaaatccggcaaagcgtacgtttcaggcaatcagaattgaattgaatcacgaactggaagtgttgcaggacaatctggatacgatgatcgatctgcttaatccgggaggaaggatctgtattattacctttcactcattagaggaccggatcgtcaagacgaattttaagcgcaacgagaatccatgtacctgcccgagtgatttcccggtatgtgtatgtgggaaaaagtccaagggaagagtgattacaaggaagccagtattgccgggggagagagagcttgcagagaactcgagatcgaagagtgcaaagctccgcgtatttgaaagagcttagagtgtagtgagggaagtggcagttatgagaaatgaagcggcagagagaaaatattatattgacgggaatactgtccgcaggatggaagcagcgcctgcagtgacgagaccggatcgcaggatcagagagagccgcccggagcatgtcacaagagagagacgggagcgcgagagacgggagcgggaacgcgagattgaattaagaaacagaaagcgtgcagccagaagaaatcaggagcgtgctctgcgcatgagcaagagctatgtggcatttctcacgatggctgtgatggtgttcggcatctttaccggtgcatacatccacatccagtcggagatgacggcgcgcatgaatcagatatcaagccttgagagccagatcgcagatctgaaagccgacaacgacgaggcatacaagcggatcaatacgagcgtggatcttgacagcatccggaatacggcgatgacagaatatggaatgtcctatgcgaaggaatcgcagattgtgtactatacagtgaacgatgacgattacatgaaccagtacagtgagattccgcgtgagtaggatgacaggagaggcgcatggcaaagaaaaaaagaagaccgctgttgaaatttcccaggcgcatgcaaaaaaagctgattgtcatgtttaccattgtggcaggcatgctgatcggtctgatcgggcgcctgatgtatattgaatataccagcggtgaaaaatatgagaaaattgtgttgtcccagcaggaatacgacagcaaagtgattccttaccagagaggcgatattgtcgatgcaaaggggacagtgatggcaaccagtattgcagtgtacaatgtgatactggattgttctgttttaacgagcgatgaggattacgttgcgccgacgattcaggcgcttgtgcagtgttttccggacttgagcagcgatgagctttacggatatgtccggaatgatccgcagaaccgttatattgtgctgaagaagaaaatatcgtacgacgagatgcagccgttcgtggaactgcaggatgcgacggatgaaaagggcagaaaggtgaaccccgacatcaagggcgtatggtttgagaaggaatatcagagagagtatccgtacggatcgctcgccagcgcggtgatcggatttacggcatccggaaatgtcggagtgaacggtctggagaattattacaacagcacgttaaacggcatcaacgggcgtgagttcggctatctgaatacggataataattttgagaaaacgatcaagcaggcgacaaacggcaacaacatcgtgacaacgattgatgcgaatatccagtccgtggtggaggacaagatccgggaattcaacgaggcgtacacaggcgcctaccgcgaaggggatgcgggagcttcccatatcggagtcctgattatggatccgaataacggggatgtgctcgccatggcgaattatccgaattttgatctgagcaacccgagagatctctccgcgtattacaccgaggaagaactcgctgccatggatgatgacgcaaagatggatgcactaaaccagctgtggcagaacttctgcgtgtcgtatacctatgaaccgggatcgacggcgaagccttttaccgtgtcggcaggacttgagaccgggacggtgaccacggcagacacctattactgcgacgggtatgagacgatctccggtcatgacattcactgtgtcaagagagacggacacggaatggagacattggagcagacgctgatgaattcctgcaacgatgcgctgatgcagatgtcctataaaataggaagagataactttgaaaactaccagcagattttcggatttggtcagaagaccaacattgatctgccgggagagacgagaaccgattctctgatctataccggcgacaacatgacggtggtggatcttgcgacaaacgcattcggtcagaacttcaacacgacgatgatccagcttgccacaggcttctgctcgattgtaaacggcggaaagttctatcagccgcatgtggtaaaacggattacggatgagaacggcaacgttgtgcaggagatccagccgacacttcttcgggaaaccatctcggagagtacgtccgagacgctgcggcagtatatgtattccaccgttacctcaggtaccggagcgacagcgaaagtggacggctactcaatgggcggcaagacgggaacggcacagaaagcgggacgtgacggcgtcaactatctggtatcgtttattggatttgcaccggtcgacgatccgcagcttgtgatttactgcgtggtcgacgagccgaatgcggtggagcagtaccacagctcttttgcacagaatattgtgcgtgagatcttagaggaagtgcttccttacatgaacatctaccgcgatgagcagaccaccggaattcatgcagggtgggacattacgggaacggataccggagcgacagcgatgacggacgttgtaaacgaggagactccggtggaagaaggactggatgtgccggacacaacggataccctgccgggaaatgaagaggaggcggaaggcacagacacgccgcaggatagcggagacacgccgcaggataacggggatgaaccgcaggatagcggagacacgccgcaggataacggagatatcccacaggatagtggagacaccccacaggataacggacagcaataacagacataacctcacgaaaggatgaataaaatttcatggagaactttcgtgaggttttttctatatgtcacaggaacatgcattttaccggagcaagacattcaaccgcagaaaaatatggctgatgttcctcgccgtgtttttcgtgctgatgtttctgggcggacggctcgtctatctgatggtcttctgctcggaatactacgggcagaaggcggaggatcttcatgagagagagcgtgatatcaaggcagcgcggggaagaatcatcgatgccacgggaaaaatccttgcgacgaacaaatcggtctgtaccatttccgtgattcacagtcagatcgatgagccggagaaggtgattgcggcactgcaaaaagaactggggctcacggaggaggaagtgagaaagcgggtggagaaggtcagctccattgagcgggtcaagacgaatgttgacaaggagaccggagaccgcatccgtgcctacggcctttccggaatcaaggtcgacgaggattacaagcggtattaccctttggataccatggcgtccacggtgctcggctttacgggtgcggataaccagggaattctggggcttgaagtcaaatacgattcctatttgcagggaacgagcggcaagatcctcaccctcacggatgcgcgcgggattgagattgaaaatgcgggagagacgcggcttgagccggtgaacggctatgatttatatatttccatggacagcaatatccagcaatactgtgagcaggcggcggaaaaggcatacataaaaaagcaggcggatgaggtgtccgtgattgtcatgaacccgcagaacggggagatcatggcgatggtaaattatccggaattcaatctgaacgaaccgtttaccttaattgaggagatgggagcggatgggacggagtctgcggacaaaaagcaggaactgctgaaccgcatgtggagaaacccgtgtatcagcgacacctatgagccgggttccacatttaagattatcacggcggcggcagcgctcgaggagggcgtggtgtcgctgacagatcagttctactgtcccggctataagctggtggaggatcgcagaatccggtgcgcgaagacaagcggacacggggcagagacgttcgagacaggcattatgaacagctgcaatcccgtcttcattgaactgggcgagcggctgggcgtggaaaactattacaaatatttcaaacagttcggtctgacacagaagacgggaatcgatctgccgggagaggcggcgacgatcatgcataagcaggaaaacgtcggcccggtggaacttgcgacgatctcgttcggacagtcgttccagatcacaccgatccagctcgtgacgaccgtttcttctattataaatgggggaacgcgcatcacaccgcacttcggagtggaggtccgtgagacggacggaacgttggtcgagacattttcttatgataagagagaggagatctgcagcggggagacctcggagaccatgcagtatctgctggaaaaagtggtgtcggagggaggcggaaagaatgcgaagatcgaggggtatgcgatcggcggcaagaccgcgacttcccagacgctgccgagaagcgagcaccgctatatttcctcgttcctcggatttgctcctgcggacgatcccaaagtgcttgtgattgcgattatcaataacccgaagggcacgtattacggaggtctgattgcggcgccggtcgtaaaagaaattatggaaaacatattgccttaccttgataaatcatgaaaaataacgtatactagttgggttaaaaagcacatgttgctttcggcaaagataaaatacatgaggtgtttattatgacgtatgaaattgtaatcccggtaatcgtatcttttgcaatcagtgcattgttgggaccgattgtaattcctttcctgcgaagactcaaagtcggacagacggagcggaaggaactggaatcccatctgaagaaaaacggaacgcctacgatgggcggacttatgatattggcaagtattatcatcacatcggtgttttatgtaaaagattatccaaagattgttccgattctgtttatgaccgtcggatttggtgtgatcggctttctggatgattatctgaaggttgtgctgcgcagatcggacggactgcttgcatggcagaaaatgctctgtcagattgtggtgacgaccgtgttcgcagtttatatgggatgctactcggatgtcccgctcaccatgctgattccgttctccggaggaaaatatttagacctcggctggggagcgttcccggtactgtatctggcggtcatcggaaccgtcaacggtacgaactttaccgatggtctggacggcctcgcgtcgagcgtcaccatcatggtggcaacgttcttctccgtggtggcgatcggaacgaatgcaggcattgcgccgatcacctgtgcggttgtgggtgcgctgcttggatttttgctgtttaatgtctatccggcaagtgttttcatgggagataccggatcactggcgctcggcggatttgtggtctcggcagcctatatgatgcagatgcctttgtttatcgtgattgtcggactgatctatctggtcgaggtactctccgttatcatccaggtgacctactttaaaaagaccggcggaaagcggattttccgtatggcgccgatccatcatcattttgagctgggcggatggtccgagacgagagtggttgcagtattttcgattacaacggcgatcttatgcatgatcgccctgttaggattataggaggaagaacatggatctgacaggtaagacagtgcttgtggttggttccggaatcagcggtgttgccgcgacggaacttctgaaaaagaagaatgtgaatgtggtattgtttgacggaaataaggagctggatcttacggcgcttcgtgagaagcacccggtctttgcggatgtgaagatcatcctcggagaactgacagcggaagatagaagcggactggatcttgtcgtgttaagcccgggagtgccgacggatcttccgatggttgaggatctgaaaaaagacgggattccgatctggggcgagatcgagcttgcctgccattttgcgaagggacggatcgtggcgatcaccgggaccaacggcaagacgacgaccacggcgctctgcggcgagatcatggcaaactattaccgggatgtgaaagtggtcggcaatatcggaattccatatacctccgtggctgcggacaccacggacgagacagtgacggtggcggagatcagcagctttcagctggagaccattcacacatttcacccggcagtttccgctattttaaatatcacgccggatcatctgaaccgtcatcacacgatggagtgctatattaagacgaaggagcggatcgcggagaatcagacggaagacgaggtctgcgtgctcaattacgaggatgaagtcctgcgcgcattcggtgagacgcttcacacgaacgtgctgtatttttccagcagacagaagttagaccgcggactgtatctggacggcgaggatatttactatgcagacggagagaacaccacgaaggtcatcaacgtgaatgaactcaatattttgggaacgcacaattacgagaatgtgatggctgcgaccggcatagcgttaagcctcggtgttccgatggataagattgtcgaagtgctgaagcgttttcaggcagtcgagcaccgcatcgagtatgtgacggagaagcgcggcgtgaagttttataacgactctaagggcaccaacccggatgccgcgatcaagggcatttgtgccatgaaccgtccgacccttctgattggcggcggctatgataagcagtcggagtatgacgagtggattgaaagctttggcggaaaagtcaagctgctcgtgctgattggacagacgcgggagaagattgcagcctgtgcgcgggcacatggatttgagaatattgtgctctgtgatacgtttgaggaggcgatcgacacctgctaccggaacgcggtatccggtgatgcggtactcttatcccctgcatgtgcaagctggggaatgtttaaaaactatgaggagcgcggacgcattttcaaggaatatgtgcgtgccttaaaagaagactaggagtggagaatggcgcgaaggcaggaaaaagaaaaaaaacaaaaaccaattcgatattttgattacagcctgctgtttttgattatctttctgctttgtttcggtctggtgatgctctacagcacgagctcttactatggttccacgcgtttcggggatacggcgtattatctgaaaaagcagctgtttgcgacaagtcttggaatcatagcgatgatcatcgtctcgagaatcccgtaccggttctggatgagagtgagcggtctggcgtatctgatggcgttcggactgtgtacggcggttatctttatcggtacggaagccaaaggacaggcgcgttggatctacatcggaccgctttcgttccagccatccgagtttgcgaagcttgcggtcatcattttcctggcgacgatcatctataagacgtcgaagcaggtgggggattttaagacgctggtcaaggtcatggcgatcgtgcttcccgtcgtcggggtggtcgcatacaataacttaagtacagcgattattatccttggcatcgcggtgtgcatgctgtttgtggcgagcccgaaatattcgcatttcctgattgtgggaggcgtggtactcgcagtcggcgtcatttttatcgcgcttgcatcctaccgcgccgagcgtatccagatctggctgcacccggaagagtatgaaaaaggttatcagacgctgcagggactctatgcgatcggttccggcgggctgttcggcaagggactcggggagagcatgcagaagctcggttttatcccggaggcgcagaacgatatgatcttctccgtcatctgtgaggagctgggacttttcggcgcgatctgcctgatccttttatacctgctgattatctggagatttatggtgattgcgaacaatgcggcggatctctacggggcgctgcttgtggtcggcattatggcgcatatttccatccaggtggttttaaatattgccgttgtgaccaacaccattccgaacaccggaatttcccttccgtttgtcagttacggtggaacttccattctgtttctgctctcggaaatggggcttgcgctgtctgtgtcaaggggaataaagtttgaggttacctaaagtatgattagagaacagagaaaaaagaaaagaagacggaaaatcggactgacggctgcactgatccttctgatgcttctagcgattgcatttctgattgtctggaaagtatttacggtggagaatgtcgtggtggagggaaatgaactctattcttccgaacagatcgagcagctggtgttaaatgatgagtattcgtggaattctctgtatgttcttctgaaataccgcatcagggataccggcaaggtgccttttgtcgacacgatggaagtgacgctggatgatccgcacacggtgcatgtcctggtatacgaaaaaggaattctgggctgcttttacattgacgccatcgggcagtacgcctattttgacaaggatggattcgtcgtggagacttcttcggacgagattgaggatgtgccaaagatcaccggagtgacatgcgatgaggtcgtgctctacgagaaactgccgctggatcagccggatgtgctaaacaaccttctgagcctgacgcagattttgaaaaaatacgaccttctgccgcaggagattcactacgacagcagcttaaaaccgacgctgacctactatggcatacaggtttcgatcggttcggacgactatctgtcgcagaagattgtgcgtctgtcggcgatccttccgcagcttgcgggaatgtacggaacacttcatctggacacatggacaccggacaccacagatattgtgtttgacagagattagaaaatccttaatttgttcaaaaaagtgaaaaaattagttgataaattgaaagaaagaatatattatattgtatatgagtttataagcgggcagtatggattctgcactgcattgaaagacgatatacagaacagacggtgtaggaagaggagcaccggatgattctctgatagatggtgtgtttacatccgtttaccacaggacatgaattatgggagagaatgaaggaggaactaccttgctagagattatgacgacagaagcagataccagtgcgaagattatagtcatcggagttggaggagctggtaacaatgctgtaaatagaatgattgatgaaaatatcggtggagtggagtttatcgggatcaacacggataagcaggcacttacactttgcaaggcaccgaccttaatccagattggcgagaagctgacgaagggacttggagccggggcacagccggagatcggcgagaaggcagcggaagagagtatggaagagctctcctcggcagtgaagggcgccgacatggtattcgttacctgtggtatgggcggcggtaccggtacaggcgcagcgccggttgtagcgaagatcgcaaaagagcaggggattctgacggtcggagttgtgacaaagccgtttaagttcgaggcaaaacagcgtatggtcaatgcgctttccggtatcgaccgcttgaaagagagcgttgatactttaattgtgataccgaatgacaagcttcttgagatcgtggacagacgtaccacgatgccggatgcattgaagaaggcggacgaggtattgcagcaggcagtacagggtattacagacttaatcaacctgccggcactcatcaacctcgatttcgcagatgtgtctaccgtcatgaaggacaagggtatggctcacatcggtatcggtaatgccaagggagacgataaggcgatcgaggcagtcaagcttgcagttgccagcccgctgcttgagacaaccatcaacggtgctacccacgtcatcatcaatatttccggtgatatttctcttatggatgcgaatgatgcggcaagctatgtacaggatctcgcaggcgacaatgccaacatcatcttcggtgcgaagtacgatgagtccatgaccgatgaggctacgatcaccgtcattgcgacaggacttgagaatccgggcgcaacgagcaagatcatgccgaagttgaattatgcaacgcagacaccgaccagaccggtatccggttctacactcggaagaaccacaggaaccgctgctccgacctatcagccgcagggaggacatggtacagtaacaccgcctctgccgggtatccagagaccgcgtcagccggagagcacggtgcagcagatggacatcaagattccggatttcctgaagaattcacgcaaatagaattatagtgacataatatgaactgccatgtgtcagtccgattacaggacttgcacatggcagtttttgtgttgcaggaagattatgtcgaaccaggcagatgactcgccgcattatagagcggacttttgacaaaaaaggagacggcggcatcgtataataggtggcatgtcagagaaaaaccgaggtgaaaggaaatatatgtattttatgcagacgtatttttgatccagaattttctcatggatttccttgctgttgcaggggcaaatctttttttgaagagatgcaggaaaatgcggtggctgctgcttggggcggctgtttccgcagtgcttgggctgtgctgcatcctgctttgccgcaattatctgctgtactgcctgctcacgcattttctcatcaacacactgatgacggtcatctgtttcgggaggtgtgacaggaggcagttctttgagaactgggtggcggtgtatctggtggttcttctgctcggtggggcgttagaatggctgcaggagagcggtattttatcaaaaagcagaggagtagcgatcgcggctgcagtgacggtaacgtgcggtcttctgcggtatcttgggagaagaagagcctttggcagccatgtgcgccgggcatggcttggaaaagatgcgcgccggatggcgttaagcgcttactgggacagcgggaaccagttaagagatccctataccgggcagccgatctgtattttgagctatagtctggcggaaaaatttgtggatcagacaaaagacagaatccggtttgtgccgtaccgtgctcttggagcagaggacggacttcttgcggtgatggatgtggatgagatgatactgcaggatggcaggcagatgcggcggtatgaacatatggcggttggaatcgcacagaaggggttgcttgaggacaaagaatatgacctgattctgcatgcatccctgggatgacagtgaagaaaggagcttacatgtacataaaatggatggtcccggattacgggatgcggggaattttgaacggaatcggacgctttttgttcggggagaatgatgaggtgcactatatcggcggcgcggaggtgctgccgccgccgctggatgcaggggaggagagcgtgtgcatccggatgcttgccacagatgcggcggaggaggcgcggagaaaactgattgaacacaacctgcggttggtggtatatattgcaaaaaagttcgacaatacgggagtcggcgtggaggatctgatctcgatcggtaccataggtctcatcaaagcaatcaatacgttcaatccggataaaaacatcaagctggcaacctatgcgtcgcgctgtatcgaaaatgagattctgatgtatctgcgcaggaacagcaagaccaggctggaggtgtccatcgacgagccgttaaacgtggactgggatggaaacgaattgctgttgtcggatattttaggaacggatgaggatgtgatctaccgggatattgagacggatgtggagcgctcgctgctcatgacagcgattgccggactgaccggcagagagcgcatgatcatagaattgcgcttcgggttgaacacggcgggaggggaggagaaaacgcagaaggaggtggcggatatgctggggatttcccagtcttacatatcgcgtcttgagaaaaaaatcatgggacgcctgaagaaagaaattgtgcgctttgagtagtgccgcccgggattgtgaaaaaagagacataggaaaagaattgtaaccgcagggcattgcgtgtataatggtcttatcaagaaaatgctggggggaatgcatatgaagcttgaatttttgggggctgcacacgaggtgacaggaagctgtcattatctggagtttgcggataagcatgtactggtggactgcggtatggaacagggaccggatctgtatgtcaatcaggagataccggtgaacgcgtcgacgatcgactatgtgtttgtgacgcatgcgcacatcgatcattccggtctgcttccgatgttatataatcatggcttccgcgggcagatttttacaacgacagcgacacatcagctgtgtgagattatgctcaaggacagcgcacatatccagatgtttgaggcggagtggaagaatcgcaaggcgaagcgcgccgggaagccggaggtcgtaccgctctacgatatgaatgatgcggtgggggttctgggacattttgtatcctgcgattaccacagcgtgatcaacgtctgtgagggcttaaaagtccggtttgtggatgcgggacatctgcttggatcttccagtattgagatgtggatctccgagaacaccggtgagggcgtggaggagcgcaagatcgtattttccggagacatcggaccggggaaccgcccgctcatcaaggatccggagtatcttacgtcggcggattacgtggtcatggagtcgacctacggcgaccgcacgcatgagacgccgccggattatgccgtggagcttgcccgcgtgatccgcgatacgtttacgagaggcggcaatctggtcataccggcgttctcggtgggacgtacgcaggagatgctgtattttatccggcggatcaagacggagaatctgcttccggaattccagaattttgaggtgtatgtggacagtccgctcgcggtggaagccaccacgatttttggcaagaatgtgcaggactgctttgatgacaccgcgctcgcgcttgtgcagcagggcatcaacccgatcggttttccggggcttcggatggcgatcaccagcgacgagtcgaagatgatcaattttaacgacaagccgaaagtcattctctctgcgtccggcatgtgcgaggcggggcggatccggcatcatctgaagcacaatctatggagaaaggattccacgatcctgtttgtcggatatcaggttccgggcacgctcgggaatatgctgttaaacggggcaaaggaagtgaagctctttggcgagacgatcgaggtgcaggcgaagatcgagaaccttccgggaatcagcggccacgcggacgtgaaccagctgactaaatgggtgagcatgtttgacccgaagccgaagcgcgtttttatcgtacatggcgaagacaaggtgacggagcagtttgcggcgcatattcacgaggagctggggctggaggcttacgcgcccttcagcggtgatgcgtttgatctgctgacaggcgcctgtgtggcacagggctccagagaggcggtggagaagaagagtacccgcgcagtcaacaatatctttgcaagacttgtggcagccggcgagcgcctgatgacggtgatccgcaagtgcgagggtatgccgaaccgcgaacttggcaaatttgcggaccagatcaatgaactctgcaacaagtgggagcggtaggcattacagggagagataggtgcggatggattttaaggcggatttttcaagacggctgacctgtgcctgggagatgtgaatctcctcggcgacttccatctgtgtctttccctcgtaaaagcggaggcgcaggatgaagttctcgcgctcgttcagatgattcatggcgtcgtttagagagagttcttcgatccagttgtcctcgcggttttttttgtcactgatctggtccatgacgtagagggtgtctcctccgtcggtatagaccggatcgtagaggctgacagggctctggatggcatccagggcgaagacgatctcctcctgggtgagaccggagacttttgcaatctcttctaatgtcggttccttgcaggaggttttggcaagaatctcgcgggtgtggatggctttgtaggcggtgtcgcgcagggaacggctgacgcggatcgagttgttgtcacgcagataccggcggatctcaccgatgatcatcggaaccgcataggtggagaactttacgcccagtgcaggattgaagttgtcgatggatttgatcagaccgatgcatccgatctgaaagagatcatccacattctcgtggtttccggaaaaacgcttgatcacacttaagacgaggcggaggtttcccttgatgtaggtttcgcgggcagtggcatctccctgtttgatgcgtgtgaagagagcgtccttttcctcttcttttaaaacaggcagcttcgcggtgttgacaccgcagatttcaactttgtatgaagacatgatgcgtttcctccggtttgattttctgttaaaaagcatgcttcattcggggcgtttttatacagaaaattttcagcaggaaatgcaaaatgttatggaagtacggcagaatttgtagtataaataaattagaaaataagtggggcaggtcgacagtatatgttggatagaatcgatgagagagacaagcaggaacggatgcaccgcagtattgtaaaatactggaatgtgaattatataccgacaccgtatgcggagccaaaggaagaacagaccggggagaaagaggatgcggttaccgggcagcagcttcctgtggagccggagctgacagtcagctcggcgaattacggcaatgaggaagtgaccgatgaggtgacaaaagggcagatcgacaagattcttcatgagaagacggaggcgatccgcagcctgatcgagcagaacaagcagacggaagaggagcaggatatccctgaagagatggcatccgcgccaatacagcatataatagaataagaacagataccggagacatttatggcagagataacactgcgtaaataccatgggctgggaaatgattatttgatctacgatccgaatcgcaatgcatgtgaattgcaggaaaggcaggtggaagcactttgccggcgcaatttgggagtcggagcagacggcattctctatggccctttttttgatggggacaaaatgcgggtgcgcattttcaacccggacgggagtgaggcggagaagagcggaaacggtatccgcattttttccaaatatttaaaagatatggggtatgtgacagaggagagctatgtgctgcacacaaaagcgggtgagaccagggtgacgtttttaaacgagcagggcgatctcatgcgcgtggacatgggatacccggagtttgtggcaaaggaaatcccggtggtcgggtttgagggggagattgtcaacgaggcgatcttttttggcgataatttctataacgcgacctgcgtctccctgggaaatccaaattgtgtgctgatgctcgaggaggtcagccagaaaaaagcgatgcagcttggcccgtatgtggaaaattccagatattttccgaaccgtatcaacatgcagctctgtcaggtgctcgaccgggaaaatattcagatcgagatctatgagcgcggcgcgggttatacatacgcgtcgggaacaggagcctgtgcagcggctgccgcatcgcacaagatgggatttgtcggcgaccgtgtgacggtgcatatgcacggcggggagcttctggtggaatttgcccgggacggcagaattgacatgacaggaccggtggtttatattgggagcattacgctcgcggagcagttttttgcgtgaaaaattttacgggagaaattttgccgttgccttttttggcagactgtgataaaatgtcagacgttgcgtagcccataaaaacaaggtctaagcgggcttgccgccgatttccggcgttaaatgaatcgagtgttcgagaccttccactcgtaaaacaaaactaaaggagaacagaatatgagaaactctaaggtacaattcattgtgcacgctgcgatgattgcagcaatctatgtcgtgctgacctattttatcagtgcgttcaacctggcatcgggagccattcaggtccggatttccgaggcgctgaccattctgccgtactttacaccggcagcaattccgggactgtttgtgggatgtctgcttgccaaccttctgacgggagcagccatctatgatgtgatcttcggcagtctggcgacgctgctcggcgcagtcggaacatatctgctccgcaagcacaagtttttatgcacgctcgcgccggtggtatcaaatatcatcatcattccgctggtactccgctacggatatggacttaccatggaatatggcggaagagactggtcgattccgttttacatgctgaccgtcggagcgggagagatcatctgctgctgtgtgcttggaacgattcttttgaatgcactcgcaaaagtgcgcaatgcaatctttaaaaaagaggattagattagaaaacaccagctataggaataacctataactggtgctttttttttcatattagacaggttggttttctcatgttatcatcagattatcaacagacagaacttccaaaatgaaaataaaaggagaaacataacatgggaaaagcattaaaggacagaaagttaaaatttgagacattacagcttcacgtaggacaggaggaggcagatccggtgaccggagcgagagcagtgccgatctaccagacatcttcttatgtatttaacaacagtgagcatgcggcggcgcgtttcggactgaccgatgcgggaaatatctatggcagattaacaaacccgaccgaggatgtcttcgagcagagaatcgcagctttggagggcggtgtggcagcgcttgccgtggcttccggtgcggcggcgatcgcctatacactccagaatctggcgcatgctggcgagcacatcgtggctgcaaacaacatctacggcggcacctacaatctattggcacatacattcccggagtatggtatcacgacaactttcgtcgatccattcaattacgacgaggtggagcaggcaatccaggagaacaccagagcgatccacattgagacgctcggcaacccgaactcggacgttgtggatattgagaagatcgcagcgatcgcgcatgcgcatcagattccgctggttgtggacaacacttttgcaacgccgtatctggtccgcccgcttgagtacggagcagatattgtcgttcactcggcaaccaagtttatcggcggacacggaacagccatcggcggcgtgatcgtggacggcggaaagtttgactgggaggcaagcggcaagttcccgtccttgacggagccgaatccgagctaccacggcatcagttttacaaaggcggcaggaccggcagcgttcgtcacaaagatccgcgccattttactgcgcgacaccggtgcaaccatctctccattccactctttcctgtttttacagggacttgagacattgtcgctgcgtgtggagcgccatgtggagaatgcattaaaggtcgtagaatatctgaacaacaacccgaaggtggagaaggtgcatcatccgtcggtatcggaggatccggtgcagcaggcactctacaaaaaatattttccgaacggcggcggttcgatctttacgttcgagatcaagggagatgagcagactgcaaaggatttcatcgatcatctggagctgttctctctgcttgccaatgtggcggatgtgaagtcgctcgtgattcatccggcatccacgacacattcccagcttacgacggaggaactgttagagcagggcatcaagccgaacacgatccgtctgtcgatcggaacggagaatgtggacgatattattgaagatcttgcggaggcatttgcggcagtatgagattattgattgtacggcacggggatccggattatgagcatgacaccctgacggaaaaggggtggcgcgaggcagagcttttggcagaacgcctgtcaaagcttaatgtcaaggagttttatgtgtcgccgctcgggcgggcgaaggatacggcgtccctgacgttacagaagatgaaccgcgaggcaaacgaatgtctgtggctcagggagttcgacacgaagatcgaccgaccggattgcccggatcgaaagtcgattgcctgggactggctgccggaggactggacgagagaagaggagttcttccggcgtgacctgtgggcgacacagcaggctatgcgtgggggactggctcccggcgcgcatgagggaaacggcgtccgtgtgcaaaagaaaccggacggtggcgtaggtgcagagtatgcctgggtggtatcaaactttgatgccctgctggcggagcacggctatgtgcgcgagggcgacatctaccgtgtcgcacaggcgaaccgcgatacgcttgtgttcttctgccacttcggactggagtgtgtgctgctgtcgcacctgatgaatgtgtcaccgatgattctgtggcatcacacctgcgcggcgccgacgtccgtcactacggtgtataccgaggagcgccgtcccggcgtggcatctttccgtgtctgcgggttcggagatacctcacatttgtatgcgggtggcgagtctcctgcattttcgggaagattttgtgagacctatgcgtgtgatgaggaacggcacgattagaaaacagaaggaattgtcataataagcatagaattcttttgggtaattagtaatattattagaagatcacaccgtgggatttcagatgaaaatgcagagggaaattcgttggagaaaaatgtgagcatttcttccggctgaatgtctgcatcggatttcgtgtctcttctacgtttggacaatccgacgggtgcatgtccgacacaccggagacaatgggcggactttttagacctgttaagagatgtcaacacaatttttgatttttttgcataagaaataggcctgattattcaggcttttttcttatgcaactatactatattcttatatatttccattactcttgcataatagatttgcaaaaacttatttaaaccggctattttggcttgtttcttactttttccttcattctcttttttaattataaaatcatagacacgagtatctgttttgggcggatgggatttcagacttttcataacctcataaccggttttccttaatgcactgtttccgcgtttgcttattctacgtttggtgccggtatattgtcctgattgataaggcggagcatcaattcccgcataagcaactaatgctttgccattatggaaacgtcgaacgtctccaatgtcagctataaaccttacacataacttttcacccatgcctcccatttggcgtatcgtttgatattctggtaaagtctttgcaagattttgcatttgtgataatatttgttctagagcataacctaattggcttacttgctctgttgctacttccatacagagtctggttgaagggaactctgttggtagtgtagggataccgtcttccgccaagtgaaaaagctcgtctgccttttctgattggaaacggtatcctttttctttacaccattgcttataattctctcgaaaaatttcttttcccatgctttttatcatatcaacatgatagaattctttggcaaaatccacatatttcacttttgagaattgaacactgcttgctgtatccagcgcttctttgaaaccaggaagcatctcatccatcaaatgtattacattctgtttagcaacaatcaaaagctttatgtatgtctgatactgcttggataatagacttaattctgtgtagcagcttggatgaaatttatatggtttcagttcactccagtatgccaaaccgtactttgctaatttttttgcatcaagcggatctgtttttgcgccatgcagcataatgcgtgaaaattgtcgtataatatatgcattttcaacacatacaaaaaagcctttttgatacagaaattgtgcaaccggaagatgataatgccctgttgattccattacaatacgaatttctccatcaagtgatccgatgtaatcagctaacattgacatttcttctacggtatgcaaaacttcaaacgattccttaataatcgtattaggatgtatcatggcacagacagtgcttttcccttttgatacatcgattcctacacttactatttgtttcatgcaaatcctccttttctccgccagacttattaccattcagacttgttcgttacacggatgtatttaatccaacctgtttaaacgaatgcttataataagaggcggaataaactctaaaaaacgggagctatgtcccaccgcactagccttatccgccttttattataataaaaataagcatgcggatacatacataatgtatctacatgcttatagtacaagccgcactagttgtactccctcatagacaatataaaaccgcgcgaaccgaaactcgttgtcatctgctattaaaaatatggcagatggcaattcagacatcggcttcgcgcggttatgttttattgcgggagtacaggcaagtgcggcacaaaagtcctacaaattgtctcccgggatgcggacatgacccgcggagtgctccaaacttggaaaaacacggatcatcgaagatgcagacatcaggctggctagaaatgccacattttttgaaccgaatttccatctgtatttccacatgaaatccacaagtgcgtttcttataatattattgcttattaaagcatgatatgcttattgtgacagttcctttgtgtgataggaaatatgtaacctgcagttacatggaaatccacccgaatgcattggcaactgagcttgcaagaatgatcatggtgaaaaccgggcataagtatttgatcatcaaaacaaaaatctttttccggcggaaggtgccttccccgtgcaggatttcttcctccatgcgatcgattccgattaccctggatacaagaaggcttgtcatcaaggcagcgaccggcatcatcacggagttggtcagaaaatcaaagaaatccagaaactgcatgccgatgatccggatgtttgctaacggaccataacctaaggaggagaggcttccgagcgcaatcatgatcacgccgaccaggacggtggatttcctgcggttccatccaagttcgtcctcaaaggtagagaccgcgctttctgtcagtgcaatcgaacttgtcacagcggcaaaaagcaccagcagaaagaacaggataccaacgaaagtgccgagtcccatattggcaaatacttttggaatcgtgatgaacatcagcgccggacccgcctgcagcgtgtccggatcgccgcctgaaaatgcaaataccgcggggataatcataagtcctgccataatcgcgatggcagtatcaaaaatttcgacgttcttggtcgatccctcgatggaagtttcctttttcatataagaaccgaaggtaattaagattcccatggcgatggagagtgaataaaacatctgccccatggctgtaacaacagtcatccacgaaaaattcgccggattcggtacaagaaaatatttcacgccggcaagcgctccaggtcttgtcacagaataaacggcaatgatcacggacagtacgacaagaaccggcatcataagcttggaaacacgttccactccgttacggactcctgcaaaaataataaccagcgtaaacatacagaagagaacgaaacagagctccgtcgatgcgccgtctgagataaaggcggaaaaataaccgtcttctgcaagcttagccccgtctccgcggatgtattcaagcaggtatttgatgacccatcctccgattacagagtagtaggggacaatcaggatcggaataatagcgttgatccatccgccgaaggaaagccatttttttgtcccgaaggactggaaagcactgactggacttttgcgcgtcatccgccccagggcactttctgcgacgatcatggtgtagccgaatgtgagcgctaacagaatgtagatgagaagaaagattccgccgccgtatttagcagccagatacgggaatctccagatatttccgagacctacggaggcgcctgcggcggagagtacaaagcctatttttcctgagaaggaacttctgttgtctttagaattcataattttatcctctttgatgtattgtgtgtaatgagagcacacaaagcctattttagcatagatggcagagaatgtcacgatagcccggtatctttttcgtgttgtttcacttgagaaatggtctgtttatggtataatgtgatacaggttgtaaagaaacagtttgaacgaaatgcaggagagaagaatatgaaaaagatcttagaccttatcaccggggaagtcacacaggcatttgtggactgcggttacgatgcaaagtatggcaaggtgacattatccaatagaccggatctctgtgaatatcagtgcaacggagcgatggcggcggcaaaggagtacaagaaggcgccgtttatgatcgcggacgaagtggcggagaagctttccgggaatgccatgttttccatggtggaatctgtaaagccgggatttttgaatctcaagctggatgaggcatatctggcggattatgtggcaaagatgcaggcggacgagggaagatacggctgtgagaagaccaaagagccgaagacgatcatgatcgattacggcggaccgaacgtggcgaagccgcttcacgtcggacatctgcgctcggcgatcatcggcgagagcatcaagcgcatcggacgttttatgggacatacggtgatcggcgatgtgcatctgggcgactggggcttacagatgggacttatcatcacggaacttcgggagagaaagccggatctggtatattttgatgagaactataccggagaatatccagaggaagcgccgtttaccatctcagagctggaggagatctacccgacagccagcggcaagtccaaggaggacgccgcctacaaggaggcggcgatgcaggcaacctacgaactgcagcatggcagaagagggtatcaggcactgctttcccacatcttaaacgtttccgttacggacttaaagcgcaactataagaatctgaacgtatcgtttgatctgtggaagggggaatccgatgcccagccgtacattccggatatggtgcagaagatgaaggatgacggatttgcctacatcagcgacggtgcgcttgtcgtagatgtcaaggaggataccgataccaaggagatcccgccgtgcatgatcttaaaatcagacggtgcatccctttataatacgacggatcttgcaacgattgtatggcgtatgaaggactaccatccggatgagctgatctatgtggtggataagcgccaggaactctattttacgcaggtgttccgctgtgcgcgcaagaccggactggtaaagcctcggaccggcttaaagttcctcggcttcggtacgatgaacggcaaggacggcaagccgtttaagacccgtgagggcggcgttatgcgcctgcagtatctgcttgagagtgtgaacgaggaaatgctcaagaagatcacggagaaccagaaggcaaaggagaaccttgagatcagtgaggaagaggcaaaggagaccgcgaagatgatcgcgcttgcagccatcaagtacggcgacctctccaaccaggcaagcaaggattacatcttcgatattgaccggttcacctcgtttgagggaaatacgggaccatacatcctttacaccatcgttcgtatcaagtcgattctgaacaagtatcacagcatggggaaggatgagagcggtgcagtgattgaggcagctcattccgcgagtgagaagaaccttatgctggcactttccggattcggcgccatgatggagaacgcgtatgaggagacagcgccgcataagatctgttcttacatctatgagctggcgaatgcattcaacagcttttaccatgagacaaagatcatgtccgaggagaacgagcagatccagaagtcttatatccgcctgttagagctgacaaagtcggtacttgagacctgtattgatctgctgggctttcaggcaccggagcgcatgtaacctatttagtgagctgataaaaaagaaggggctgccgcatgaaacgggctgccccttcttttttgcgcttttttatgaccgacgcaaaaaccagtcatattttttcggacaggtcatagaattagacatagccggaaagggggcatggctttggagatcgtcaaaatattcccggtgcatataagagaggcgctggcgaacgatacatggaaggcgggactggaggagatccgtgtccgggtgggcagtccgcttgaatttatttacggcggggagagccgctacctgccggggcgggagggcgcgtatgcactgccttctgcctgcggatatgagaacggctatcggatgacgccggaggaccttcgtgagatgctcaactatatcagcgattattcactctacgcctacagtgaggaggtaaaggagggctatcttaccatcgagggaggacacagaatcggaatggcgggacaggtggtaaaaaaggatggaaaagtgacgggtcttagccatatcacctttttaaatgtccggattgcacacgagaaacggggctgcgcggatgacattcttccgcatatcaggagatcggacggtatctataatacactgatgctctcgccgcccggaatcgggaagacgacgtttttgcgggatctgatccggcagttgtccgcgggggatgcgggtgcacccggaatgaaagtgggggttgtggacgagcgttccgagattgccgcatgccacctgggaattccgcagaacgatctgggcccccgcacggatgtgctggacggctgtaagaaaacggagggaatccggatgctcctgcgctccatgtcgccgcagattctggcggtggatgagcttggtggaaaggaggattttgcggcggtaaaacaggcactgtgctgcgggtgcagggtactcgggaccgtgcatgcgggctgtgtgcaggagcttctggacaaaccgtatctgcaggcatgcgtcacacagaagctgttcgggcgctacatattgattgaacggaattcccgcggggagcgcagcaccacaatctatgatgaacggatggagcggatatgttaaaaatcatgggaagtatcctggtctttgccgcggcggcggggatggcaggcacatacaaaagagaactggcagaccatctggcacttttgtacgcgctgcggaaacttctggtggatctttcctgttacggaaatggaaccagacagccggtggaagttctgctgggatgctttgtgagaacgccggatgaacgattaaatgagatctgtcggaagattgcagactgcctgatagagaaaaacgagaaaaacggggaacaggtgtggaagagggtttttgaggaatatcggaaaaaactgtgtttaaccggagaggagagcgcgctcatcggggaggcgggcggcgcgcttttcgggagaagcgaagaagaaaatcacagaagactcacgctcattttagaacagctggatgacaggatcaaaaccgtgcggggagagcttggagaaaagcagaagatttatgcgactgtcagtatggtgatggggggaatgctcgtcattcttctgatttagacggcaggaaagcaaaacagaaaggaaagaaatacgatgagcgtgaatttgatttttaagatagcggcagtcgggattcttgtgacagtgatcggacaggtcttaaagcacagcggcagggaggagcatgcgtttttgaccagccttgccgggcttatcattgtgctgttctggatcgttccgtatatctatgaattatttgagacgatgcagtcgctgtttgcgctgtaagccgggagaaaacgatggatattgtaaaaatagcggttcttggcatcgcgggagtatttcttgcaattccgctcaagagagaaaagggagagtacagtacgtttgttgcaatggttgtgggaatctgcatttttatctatctgctcacaaaggtggagactgtactgctctttgtggattccatcaagtcgcagcttccggtcgatggcagatacatcgggctggtggtaaagatggtgggaatcacgtatgtggcggaatttgcggcgaacctgtgcagggattccggttattctgcgatcgcaggacagattgaaatgtttgcaaagctgtccattctggtggtgagtgtgcctgtgtttggagcatttttggacgcggtggggagttttttatgagagagtgtggaaagagaagcttctgtctggtgtgcatgtttttggttttgaccggaatgcctgtgactgtgcaggcggcagattatgacggcgggacggggagcgcggagaagacgcaggagacatatttaaaaacgtttctggaagatctggactttgcggaactggatacgtggaccaaagaggagctgtttccggagcagagggaaaaattcagcttctccgtgatggtgcaggaactgcttgcggatggaatcggagtgacctccatggaaaaaatcggacagtggctgtgtgatgccctgctgtatgagataaagaccggcaaaacaattctggtggaggtggtgctgcttgcagcgggtttttccatgcttaagaatttctcgggaacctttgagaaaaattatgtttccgacatctgtttcctgctggtctacggcgtgctctgtgtgctgctgctaaagtcttttgaaatctatggaacggtagcggaagaagcgctaaacggcagcatcgattttatgaaggcactcattccggcgtttggcatcagcatggtattttcctcgggggcggagagctccgccgccttttatcagctggcgtttctggtcatttatctggtggagtggctctttctttcggtgctgcttcccttcatccgtgtgtatgtggtgacggagctgttcaatcactttttcgaggatgaaaaattccagaattttacggaattattggctggagtgatctcctgggggatgaagagcgcgatgatggcggtgctcggattaaacgtcatgcagggactgcttgcaccggcaaaggaccgccttttaaacggagcggtcagccgtgcggcgatgatgattccgggggtggggaatgtgcttggaggaatcggggagcttatgttcggcgccggaatactgatcaaaaactgtgtgggggtgacggcactgatcgtgctgcttgcggtgggctgcatcccggttctaaagcttgcctgtatgtcagttctctataaacttgcggcggcggtggcggagccggtggcggataagaggattgtcggatgcattaagagcatggcgcagggaggcgtgctttatctgaagctggtctgctatggcattgtactgttttttgctacgattgcgctgcagacggcggcagtcacatcacatgcatagggggacgtgccatgaacgcatatatgagaggatttgtcattctgtttgtgcttctggtgctgctaagttatctgccgccggggaaacaataccggaaatatatccgtttttacgcgcagcttctgatggtgcttgcagcattgagaccgctgtttgtactgtttggcggaaaagatacgttttatgaaaaaatggcatatgcccagtgcatggaaaaactgtcggaattttcccgcgatacgcagaaaatcgcttatctgaatcaggacagataccgcacagagtatgagaatgtcatcgcggaaaatatcagggagaaggtggatgatatgctgcaggagtacgggcttggcacccagagcgttacggtggaactgggggaggatcatacgatgcaggagatttgtatttacatcacagatgagaacgcggatgagatttcggtcggaagaatcagcgtgtcagatgcggcagagtcaggggagaaccaggaggtctgcgggaaagtaaaggaagaactggcggcgtactacgggatggaggattccggaatacgggtgaattatgtgggaggaacgtaaatgcctgaaaaactgaaacggatcttacagaacaaaaactggcgcagctggaagaaaagcgactggctgctgctcgcgctggcggggatattattgcttgtgattgcactgccggtggagagtggggatggcacagcagaaaaggcatataacacggcacagggggaaaaggagacgtcaggcggcagcggaagaacggcgtcaggagatagtggagggacggcgtcaggcagccagacatcggaggagggagagcaggaatatgtccaatatctggagaagaagctcgagaatattctgatgcagatggacggggtgggcagagtggacgtcatgattaccgtttcagacgggggcgaacagattgtggagaaggacaaaaagacaacttcctcttcgacgggcgagcgtgattccggaggcggggagcgcagtgtgacagaacaggcgggggaagattcgacggtatacgtggagactgcagatgaaaaatatccgtatgtacagaaagagacgctgccgacggtggcaggcgttgtggtggtcgcagagggaggcgggaacccggcggcggtttctgagatttcagagtccgtgcaggcattattaaaggtggaaccgcataggattagagtagttaagatgtgttccagggaggaatcggagtgaagaaaatatttcggaaaaaccagctggtgataacagcattggcacttatgattgcggtggcaggatatttcagctacatgaacaacaatatggaagatggccaggtgacggcggaagcgagcgcggatgcgggaacggtgcaggatacatacgacatatcggaggaggatatgcttgcggagcaggagatctttaccgatgagggaaccggggaggaactggcgcttgtggaaggaacggagacggcagcagtggatgccgcgcagtccggggatgtggcacagatgacggacggtgccgcggacgtcgagaatcctggggaggcggtgcttacaagcacgacgattgcgaacctcgattatgcggcggagatgaaattaaaccgcgagcagatccgctccaagaataaggaatccctgcttgagattgtaaacaatacgacgatcgatgagagcttaaagcaggatgctgtcaacaagatgatcgccatgacggatattgccgagcgggaggcagctgcggaaatgctgctggaggcaaagggattttccgatgtggtggtgagcatcacggaagataactgcgacgttgtcttaaatatgggagaggtgacggatgcaaagcgggcacaggtggaagatattgtaaaacgcaagaccaacattgcggcggataagattgtcattaccccgattgtggtggatgagagcggggaataagcttaaaatactggtaaaagaggcggatatgtagtataatctccatgctatttgaggcatggagatttttttagattggagtaagctatggcaatgcgcatcatgatacaggggaccatgtcgaatgcgggaaagagcctgattgcggcgggactctgccgcattttccggcaggacggctaccgggtggcaccctttaaatcacagaatatggcgttaaattcctttatcacaaaagaagggcttgagatggggcgggcgcaggtgatgcaggcggaagcggcggggatggaaccgacggtagcgatgaatccgatcctgttaaagccaaccaacgacatcggttcccaggtgattgtgaacggcgaagtgatcgggaatatgagtgccagggattattttgcttataagaaaaaactggtgccggacattcttgcggcgtaccacaggcttgaggagcaggcggacatcattgtgatcgaaggcgcgggaagcccggcggagatcaacttaaaagagaatgatatcgtgaacatggggctggcggaacttttgaatgcgccggtgctgatcgccggagatattgaccggggcggagtgttcgcgcagctgctcgggacacagcttcttctggaggagtcggagcgcaggcgggtaaaaggatttatcatcaataaattccggggcgatgtgtccattcttgcgccgggaatccggatgctggaagagcgcggcggcgttccggtcgtcggggtggtgccgtacatgcagatttccctcgaggatgaggacagtctgacgacccggtttgatgcgaggcaggaggcggcggtcgacattgcagtgatacgttttccgcgcatctccaattttacggatttctcggtatttgagcagtttgaggatgtgtcgctgcgctatgtcgattcggtggaaaagctgcatcatcccgatatgattcttctgccgggaagcaagaatacgatggaggatttaaaatggatgcgccagaacggtctggaggcagcgattcttcacagaagcgcggagacgttcatttttggaatctgcggcggctaccagatgctcggaaaacagattgcggacccgcacggcgtggagacgggcggtgtgatccggggaatgggattacttccggtcacgacagagctgggggaacagaaagtgcgaacccgggttggcggagagattcttggcgggatgctggacggatgtgaactgagcggctatgagattcacatgggaatcagcagaccggagggggactgcgaacctttctgcaggatccgcgacgagattaccgggaaggaacgcacggacggcgtctttgcgggaaatgtgtgcggcacctacgtgcacggcatttttgaccatggctcaatcgccgggaagatcgtgcggcacctcgcagagaggaagggactcgtgctcggggaggacggcgtggactacggattgttcaaggagcagcagtacgacaagctggcggcaacgctgcgcaagtatctggatctcgatgcgatctataagatgatgcgggaatatgagtgacaaaagagagaggtgtgtgggatgttagacagacagcagatgagacagttgaagatagagccgccggatcaggcggtctataaggaagtcctcggcaactgggatgcgcttgcaaagccgctggacgggatgggagaatttgaggaattgtttgcccgcatcggagcaatccggcgtgatcccgcccttgatatttccagaaaagcagtggttgtgatgtgtgcggacaacggaattgtggaggagaagatcagccagtccggacaggatgtgacggcgaaggtggcggcagccatggggagagggacgagctctgtctgccggatggcaaaagcagccggcgtcgaggtaataccggtggacatcggaatcaacgaagagggatcgccggagggcgtgctgccgtgcaaagtgcgtcgcggaaccagaaattttatcaaggaacgggcgatgacggagcaggagacactggcggcgattgagattggcatggagcttgcgaagcggcttgcacacgagggctataagctgcttgcgaccggtgagatgggaatcggcaacacaacgaccagcagtgcggtggcggcggcactgttatcctgcgatccgaaggagatcaccggaaagggagccggactcagtgacacggcgcttttacgcaagattgcggtggtcgaagagggaatccagatgcatgaactctatcaggcggacgcattcgatgtgctgtgcgcagtgggcggactggatatcgccggactttccggcgtgtttatcggcggtgccctggcacatgtaccggtggtcgttgacggagtcatcagtgcggtggctgcgcttgcggcggagcggatgattcccggcgtgcgcgattacgtgataccgtcacacaagagcagggaaccggcggcggagcgcatattggaaaaactgggaatccgcccggtgttagatgcgggactggcgctgggagagggaaccggagctgtgatgatgtgcggactgctggacattgcgcggacgatctacggcgagcgcaccacgtttgcggatattgatgtggcaccgtatcacagattcgggtagcctcagagaggagtaggacatgattctggtgatcggcggaagcggcagcggaaagtcagcttatgcggaaaaagtggcattggagtgtcaaaaagagaaaaggcacttctacctggcaaccatgcatgtgttcggcgaggaagggcaaaaaaaggtgcagcgccataaaaggatgcgcgcaggcaaaggctttgtgacgatcgagcagccgacggacatcatgcagtgccttcccgcacttcgggaggccggtggcggcgtggtgctcctggagtgcatgtcgaatctggctgccaatgaaatgtttgacacggaagaaccggcgggcagtgagcaggtcgcggaaaagattgtcacgcagattggcgtgctggcgcaggagacggaagaacttgtcattgtcaccaacaatgtgtttgaggatggcatcgtctatgatacttccaccatggaatatcttcgggcgctcggcagcatcaatgtgagactggcagagcgttcggacgttgtggtggaagtgattgcgggaattcccgttgcaagaaagggaaagcttccggtagcggtggcagagaaacagggacacagacagaaaggagcaccggcatgtccgtgataaagtctttttttatagcattttcgatttattctaaaattccggtgccgcagttcgcgtggaaggaggaggacatgcgctatacgctgtgcttcttcccgtgggtcggagcggtgatcggattgtgtttcctgttgtggaaccggttcgcgggcgtgtatgggatcccgtccactgcccgggcggcggtaggagcggttctgccgcttgcaatatccggcggatttcatgcggacgggtttatggacaccatggacgcgctgcattcttaccgcgacagggagcgcaaactggagattttaaaagattcccacatcggcgcgtttgccgtgatctgttttgtgatgtatgagctgatctatctgggagcagtgtccatgatcacggaaaaagaacagattttagtacttgccgcaggcttttttttgtcgcgcaccttaagcgggatcggtgtcgtatccctgcgctgtgccaagacgaacgggatgctctatcagttcgcgagcgaggcgcaccggcgggtggtgctaacggcgctgtatctgcagcttgtactctgcgtcgggctgatgcttgccgtatcggtgaaaaccggtgctcttgcgtgtgcggcagcagggcttacctacgcgtactacagacagaagagttaccaggaatttggcggtattaccggagacctcgcggggtattttgtgacgctgtgcgagggtgtgatggcggtgcttgtggcggcggcagggctgatcggctaggaatgaagcattgcgggatgacgcatcagaaaggataacacatggaactatacattggcggatatgcacagggaaaacttgcttatgtcaaagggaggcatccgggggaaaaacatccggtgtgggacggagccacagagacgtttaccgggagaacatccaaggaggcgccggtctgtaaccactaccatctgtgggtgaagaggctgcttaaggatggagcggatgtaagagagctgaccggcaggctgcttctggaacacccggactgcatcattatcagtgatgagatcggcaacggaattgtgccgctggaccatgaggagcgcgagtaccgggagacgaccggcaggctgctgtgcgggctggcagaaaaggcagaccgcgtggagcgcattgtgtgcgggatcggagagcggatcaaatgaggtatgaggcagacatggcactgatccgtcacggtatgacgcccgggaatgaagagcaccgctatatcggaagaacggatgagccgctttcacaaaaaggcagagagcagcttctcacattgcagaaaaaaggcgtttatccggcggcagcatgcgttgcggcaagtccgctggagcgctgcagacagacggcagagctgttgtaccccggacaggcgccatgcgttttcgatcagttccgggagatggattttggcgcgtttgaagggcataactatgaggaactgaaagcggatgtccgctatcaggcgtggatcgacagcaacggaacgctgccgtttccgcaaggggagagcagagaacagttccagagacggtgcgtggagggattttgtgagctgcttaaggaagtgtggacgcgggagaagcttccggcgtcgcttgcactcatcgtgcacggcggaacgatcatggcgcttctggacgcttttgcggagggcagttattacgattaccagtgcgcaaatgcgaaaggatataaaggacgactgtctgtggaatttgatgcagcgggaaatactttaagagacacgataaaaattgcggatgtgagaaagttggaggaatgacatgctctcggtatatcatatgacggcgtttacaatcggatttgtgatggatctgctgttcggcgatccgtactggctgccgcatccgatccggtggatcgggcgcctgatcggatggctggatcgaaagctgcttggagagacagacggcgcggtgcgaaatgaagccgccgagaagaaaaagggaaggtggcttgtggcgttcgtgcttcttccggtactcttttttgcggcagcagtcctgtttgcggcgtaccggatccatccggcggcgggggttgttacagagagtgtcatgacctaccagatgcttgccacaaaatgcttgaagacggagagcatgaaagtgtacaagcagctttcggagcatgatctgtgcggggcgagaaaggcagtctccatgatcgtcggaagagatacggaatgtctggatgaggagggcgtggcgaaggcggcgatcgagaccgtggctgagaatgcctccgacggagtgatcgcgccgatgctctatctggcgctgtttggaccggtgggaggttttttttataaggcggtcaacaccatggattcgatggtgggatataaaaatgacaggtatcacgcatttggcacggcggcggcaatgctggacgatgttgtcaatttcattccggcgcgcatcagcgccatgctcatgatcttatcctgctgtttccttggaaacgaatttgaccagaagaatgcgatgaagatttttaagcgggaccggtatcagcatgccagcccgaactccgcacagaccgaggcggcatgtgcgggagcgctcggcataagactggcaggagatgccagctattttggaagaatcgtcaaaaagccgtacatcggtgatccgctcagagcagtggagacagaggatatcagacgtgccaaccgcctgctgtatgggatggcatttttcggatggggaatttgtatggctgtctggttgtgcgtgacagccattgtgtggtagcatagagacagaacaggaggaagaaccgggatggtgcagcagaacatacatggaggagacatataccgcaatcaggtatcgcttgatttttcggtcaacatcaatccgttcgggatgccgcagcgggtgcgtgaggcgcttgaggcggcagtggcatggtgtgagcggtatccggatatccggtcggaggcattgcgggatgccatcgccggggcaaaagggattgcgcctgcggatattgtgtgcggaaacggtgcgtcagaactgtttcctgccattttaagagcggttcatgcgaaaaaggtgctgcttcctgtaccgtcattttacggatacgagtatgcggcaaagtctgtgggagcagagatctgctgccacgaactgcttgagacggacggctacgcggtgacggagcgctttcttactgccatcggggagggtgtgaacgccgtttttctggcagtcccgaataatccggtgggtacggtggtggagccggaactgttggagaagattgcagagcgctgtcagaagtacggtgtgaccctgattctggacgaatgttttgtgatgtttaccggagcggaagaacgctattccttcttaaaaaagtatcggaattatccgagagttgtgatcgtgcgggcatttacgaagctctatgccatgccgggagtgcggctcggctatctcgtctgcagcgatgctgctcttacggaagcgataagagccgatctgccggagtggaatctgtcggtgtttgcgcagcaggcgggatgtgtggcctgcgggcagcgcgcgtatgtggagcactcggtggcatttgtctgcagggagcgtgcctggcttacggagcagctgtcggaaattggcattactgtgtttgcgtcaaacgccaatttcctgatgataaaagacgggcgtccgctggcaaaagagctcttaaagaaggggattctgatccgcgactgcagcaactaccggggactttccgggggatattaccggattgcggtcagacggcgcgaggagaatgaacgcctgcttgcggcgctggcgcaggtgacgggaagcagcgtggtggaaaacggcaaagatgataaaaagccggcagcagtgcccgacggaatcgagtatgtgatgccacaggagatagagaagcgcagcttttccatcatcgaggaagaattgcagcttcgggggattacgctgcctgtggaggaagcaatggtcacgaagcgtgtgatccacacgagcgccgatttttcctatgcgcagacgatgacctactccgcgggagcggtggagacggcaaagtggctcatcacagagggcgcggacattgtgacggacaccaacatggcgctctccggcatcaacaagcgcgtgctcgcacgctacggcggatcggtacactgctttatggcggacgaggatgtggcaagagaggcgaaggagcggggcgttacccgcgccaccgtgagcatggaacgggcggcaaagatcgaaaaaccggtcatctttgcgatcggaaatgcgccgacagctttaatccagctatacgggatgatagaggagggctaccgcccagcgttcatcatcggcgttccggtcgggtttgtcaatgtggaggcggcgaaggaactgattttacagacgaagataccgcatattgtaaaccgtggaagaaagggcggcagcaatgtcgcggctgccatttgcaatgcgattctctacgagcttgggaggtgagcccatgcgctatggatttacgacgggaagctgcgccgcagcggcggcaaaggcggcggcttatatgcttcttaccggcagagaaaagcacgagattaccatcaccacgccaaaaggcatcctctaccatgccaggatggaagagatcagccgcacggagcattccgtgcgctgtgctgtcagaaaagatggcggagatgatccggacatcacgacgggaacactgatttttgcggaagtatcctggcaggagcagaaacaggaaaaagactgcggaaaaccgcagattcttattacgggaggcgcgggtgtcggaacggtcacaagaccggggttagaccagcccgtcgggagcgcggcgatcaatcatgtgccgcgggagatgattacccgcgaggtggaagaagtgtgtgcgcttaccgattatgcggggagccttttggtggagatttcggtgcaggggggagaggaacttgcccaaaagacgttcaacccgagactcggtattgtgggcggtatctcaatccttggaacgaccgggattgtggagcccatgagcagtcaggcgctccttgacacgatctatgtggagcttaagcagaagcgcgaagagggaaaccggtttgcggcaatctcaccgggaaattacggtctggaatatatgaagcgcgcttacgggttcgatctggaccgaagcgtcaagtgcagcaattttatcgggaagacgatggatatggcggtggagctcggatttgaggcggtgcttctgaccggacacatcggaaagctggtaaagctctccggcggaattatggacacacattccagggaggcggacgcgcgcatggagcttctgatggctgcggcataccgcgccgggtgtgcgcccgatacgctggggaagatcttagactgtcttgtgacggaggaggcgctcgcctacattgtcaaggacggatgtctttccgcgacgatggaacttttaatgaaaaagattcttttttatttaaagaagcgggtgaaagaggaactgcgtgtggaatgcattctctatgcgaacgggtacggcgagctggcgagaagcgacggtgcggtagaacttctggaacgaatccgcggggaagaagaacatttgcagtaacgcagtttaaggaggaaacgatatggtatattttgtcggggcgggtccgggagcaaaggatttaatcacggtccgcggaatgagactgctggagcaggcggatgtcattatctatgcgggatcgctcgtgaatccggagcttctttcttatgccggaagcggggcaaagatctatgacagcgcaaaaatgacgttggaggaagtgcttgcggtcatccgggaggcggaggaaaaagggcttaccaccgtgcggcttcacaccggggagccgagtctctacggggcggtgcgtgaacagatggatgtacttgcagcggaggggatttcctatgagagctgtcccggcgtcagcgcatgctttggcgcggcggcggatctgaatctggagtatacgctgccggggatctcgcagagcctgattatcacgcggatggcaggacgcacggcagtgccggagcgggagagcatcgagagttttgccgcacatcaggcgtccatggcagtctacttaagtgcgggaatggtaaaagaactgtcgaaaagactgatggacggagggtatgcgccggatacgccggcagcgatcgtctataaggcgacctggccggacgaggaggcgtacgtgtgcacggtggagacgcttgctgctgtggcggtggagcatcagattacgaagacggcgctgattctggtgggagatgtgctggcagcgccggggtatgagcgctcgaagctgtatgatcccgggtttaccacgggataccggaaggcaaaaaaggaacagggagagacaaagtgaagaagacggacatagctgtcatcagctttacttacaggggggcagaactggcagaacacattcaggaagcgatggatgccgtatggtcctgtaaattatatacaaaatgcagcgacgcccgggcagaggggatagggatttccgtggatcagccacttgccgaatggacaggaaaacagtttgcggcgggaaatgcgctcctgtttatcggggcatgcgggattgcggtcaggagtatcgcaccgcatgtaaaagataagctttccgatgttccggtgctcgtggcggatgaggcggggcagtttgtgatcccgcttcttgcaggtcattatgggggagccaaccggcttgccggggaactttcaagagccctcggtgcgactgccgtgctcaccacggcgacggatgtgaacgggctttttgcggtggatgtgtttgcagcgtcaaaccgtcttgccgttgccggtcatgacggaatcgcccgggtgtccgccgggcttctgcgcgccgggtatcttaccatgtccgtcgccggagaatgtgaaggagagattccgccggaggtaagactggtaccgtatccgccaaaggagccggtggatgtgctggtcgcgccgcagtgcgaagccggggaacgatgcagcttatggctgattccgtcctgcctgctgcttggcgtcgggtgcagaaggggcaaaagcgaagaggaactggaagcgtttgtgcgggagaccctggaaaaagagaagctttccagcatggcggtggcgggaatcgcgtcggtcgatgtaaaagcggatgaggtaggaattctggcactggcagagcagttagcggttccttttctcacttatccggccgggcgcctgcagtgtgtggacggtacattcacgtcatccggctttgtggcgcaacaggtcggcgtggataatgtgtgtgagcgcgcggcggtctgcgcggcgggggagggcggcagacttctggtgcaaaagacggcatgtgagggcaagacgcttgccatagcagagaaaaaatggagtgtgaagttttgatgaaacatgaaatctatattgtcggaatgggaccgggcagagaggaagatatgacacaggaagcgctcaccgtgctggattcctgtgacgtaattgtgggatatacggtgtatctgaatcttctcggggaacgatttttggggaaaacgtttttgtcgactccgatgcgccaggaagtggagcgatgcaggatgtgctatgaggaggccaagaagggaaagcgcgtagcgctgatctgtagcggggacgcaggaatctacgggatggcgtcactcatgtatgagatgagcgcagaatatccgtcctgtgaacttacggtggtaccggggattaccgcggcaagcagtggtgcggcagtgctcggcgcgccgttaaaccatgacttctgcgtgatcagcttaagcgatcttctgactccgtgggagcagattaaagcgcggcttcgggcagctgttctgggggatttcgcgatagcgctctacaatccgtcgagcaggaagcgcgcagattatctgcagcgcgcctgtgatattctgctggatgccggggcgaagggaacgcgtgcctgcggctatgtggaaaacatcggaagagacggggagacggcacacacctgcaccctgcaggaacttcgtgagattcaggtgaatatgtttaccacggtatttatcggcaactcacagtcggtcattatgggagataagcttgtcacaaagcgcggctatcagatcggggcaggcgccagggcgcgtgcgaaggagcgcggataagaggtctggaaatggagagaatatggcagaaatattgattttttccgggacaacggagggaagagaattggcggaggcactctgtgccagacagattgactgtatggcgagtgtggcgaccgagtacggcagggaagtgatgcgtcagcaggagcatcttgtgatccgggaagggcggatgggcgaaccggagatggaagaactcatgcgaaccggtacatttcttgcagtggtggacgccacgcatccctacgcggtggaggtgacggagcacatcaaagagagcgcaaaaaagaccaatcttccctatttaaggctcagccggagcacggcagcggagcgtgagatcgcagagcacgagtggatgatacatacggtggcggacacgcaggaatgtgtagaactgctgtctaagctgccggggaacattcttcttacgacgggcagcaaggaactgcacgcatatgccgcccgggaggagatccgtgagagactttttgtgcgtgtgcttccgggggtggagagcatcgaaatctgccacagggaacagattccggggaagcagatcattgccatgcagggaccttttggaacggagctcaacgaggcgctgatccggcagtatgacatcggcgtgctggtgaccaaggagagcggacaggcgggcggatttccggagaagatccgcgcggcagagcacacgaaaatcccggtggtcatgattcagaatccggagcaggcgggcgggatgagcatggaaaaagtcctgtccgaaattgaaacgctctgcgggaaaaagagcgggacgaagcgtcagccgctgcagatttctcttgtgggaatcgggatggggaacacaaagttgttcaccggagaggcaagggaggcgattgggcaggcgaaggcggtctgcggagcgaagcggctgcttgccgcggcggataccctgatcgcgccggatgcagagaaacgggaggcgtaccttcccgcagatcttcttccgtatatttattcctgcagggaaagaaaaatcgggcggattgccatcttattttccggtgataccggattttacagcggcgcagaggcggtgtataaggcattgcaggaagaagtgcgccttggaaaattacaggccgggatcaccatctgtcctggaatctcctcgctctcctatctggcggcgcgcgcaggtaaaagctggcaggacgcgaagatagtcagcacacacgggagagaggcggatgttacagcgtatgtgcgcagtgaggaaaatgtatttctgattgtttcaggcagaagcgatctaatccgcatcggggaagaacttgaggcggcgggactgtccggggtggagcttaccatcggataccagctctcctacagggaagagcggatctggcacggaacgccggaagtgtgccggacgttaaaggacgatggactctatgcctgcctgattgaaaatccgggggcacagggggagacgctcgctccgggagtccctgaccgctggttcgtgcgtggacgagtccccatgacgaaggaggagatccgctggctgtctctgtgcaggctcgggttaaagagtcagagcgtattttatgatattggaagcggaaccggctcgattgcggtggaggcggcgctgcggtcaaaacagctgcgggtgtatgccgtggaacatggagaggaagcctgtggactgattgcggaaaatgcatcgcgtgcaggcgtgaagaaccttgttgtcgtaaagggggaggcaccggaatgtcttggggaactcccggtgccgacgcacgcgttcatcggcggaagcggcggcaggctgcgggagattcttctggcactccgggagaaaaatccgaacgtgcgcgttgtcttaaatgccgtctcgcttgagacggtcgccgaggttgtggcactgtggaaggagcttttgatctgtgaggaagagatcacacagattgcggtcagccgcgcaaaaaaagcaggttcccatcatctgatgcaggcggagaatccgatctatgtgatctcgttttccctgtcggagaacggcgagggggaagaacaaaaaccggacagacgggaggagaggtaagatgaacattcccagaatcatgattgcggcggcgggaagcgggagcggcaagacgcttctttcctgtgcgctgatgatgcttttttcacaggaaggaaaaagcgtcagtgccatcaagtgcgggccggactatatcgatccgatgttccatcggacggtgctcggcgtcccttcccggaatctggacacttttttcactggggagagactgacgaaaagcctttttgcgcgcgcggcagagggcgcagaccttgcggtgatggagggcgtgatgggactttacgacggcctcggtggaatccgcaaggagggatcgtcctaccatctggcagaggtgacgaagacacctgtgattctggtggtgaacgcacatggaatggggcgttccattctgccggtcataaggggctttctggactatgaccggcatcatctgatccggggcgtgatcttaaatcagacatcggtgacattctgtgagacaatccgtcccgaaatagagcgcgagctgtcgctgccagtgctggggtgtctgccgaagttaaaggaactgcactgggacagcagacatttaggacttgtgatgcccgaagagattgcggatgtgaaaaagcagattcagacggtggcggatacgctcggaaaaacgcttgactgcgggaagcttcttgcgattgccgcatccgcagaagcgctggagacagatccggtgccgaaaaaaaagattgcggatgtaagaatcggaattgcaagagacgcggcgtttggtttttactatgaggacaatctgcagctactgcgggaggcgggagccgagctggtgccgttctctccgttacaggatgagagcctgccggaggggattgcaggactgatcttaggcggcggctacccggaactgcatgcaaaagcgctgtcgaaaaacatcccaatgcgaaaagcggtgcacgacgcggtggcggacggtctgccgacgatcgcggagtgtggcggattcctctatctgcatgagacgctctgtgacgatgagggagtgtgctatccgatggcgggagtgattccggcgtcggctataaataccgggaaactggtgcgcttcggctatgtgatgcttacggaaaaggaggagaacttcctcccggcgggcgcacagattgcggggcatgagtttcactattatgacagcacggacaacggcgtgggtgcggtggccaaaaagccggtaaacggaagatcgtgggagtgcgttcatgagagtccgtcgcaatggatgggattcccgcatctatattattactccaatccggaatacgcgtaccgtttcctgaaaaaggcggcggacagaatctacttgaaaaaataaacatgcaatggtaatatgtttttaatttcataaaaaagtaactggtgccggtgcaaaggtatgtgcagaagatgtacagatgagcctttgtaccggttaaaagggaaacaggtgggaatcctgtacgatctcgtcactgtgattagggagtgcagatacgaaagctttacgccactggcgcgcatgcgccgggaaggtaagtagctgcatgaggatctatcagccaggaaacctgccagttatgatagtacaggaagagattccggatcacgagtaattggtcgtacttttgtgtgttgatcagctgctccgtttctatgtttcatagagcggagtttctttctgttgttttatggaaaatatacaatcatcagcaggaggaattatgaaaaaaaagacactggcactcttactaagcctgacacttgcagctggcatgatcggtggatgcggcagtaagacagagacaaccacagaggagaacgtgcagacagcacagacagaggctgttgcggagaccgggacagagacagtatccgatcaggatgcggcagatcatgttgctgcgctgatcgatgcaatctacgtgcaggagcgcacggatgagaccgatgcgcagtgtgcagaggcaagggcggcatgggatgcattgactgacgcacagaaggaacttgtcgaaggtgagaacgcagatccggattatttcggaagagataccggagacgcttccaaggacgatccgttaaatgaggatgagatcggtgagaatgagatccttgtcgtaagtttcggaacatctttcaatgacagccgtactgaggatatcggaggcgtggaaaaagcaatcgcggaggcttatccggactggtcggtaagaagagcgtttaccgcacagattatcatcaatcatgtacaggcgagagacgatgagaagatcgacaatgtagaccaggcgttagaccgcgcggtggcaaatggggtgaagaatcttgtgattcagccgacacatctgatgcatggcgcagagtatgacgagctgatggaagcggtggagaagtaccgcgatcagtttacatccgttgcagttgcagaaccgctcctcggtgaggttggcacagatgcaaccgtgatcaatgacgataaggaagccgttgcaaaggcgatcacggcagaggcagttgcagaggcaggttatgactccctggatgcggcagcagaggatggtaccgcattcgtattcatgggacatggaaccgctcatactgcgaaggtaagctacagccagatggcaagtgtgatgaaggacttaaactacgcgaatgtcttcatcggcactgtggaaggagaaccggaagagactgcatgcgaggcagtgatcgaggcagtcaaagaagccggctacacgaaagtggtattaagaccgctcatggtagtggcaggagatcatgccaacaatgatatggccggggatgatgatgattcctggaagagcatgtttgaggcagacggagcgtttgagagcgtcacatgccagattgcaggtctgggaagaatcgatacgatcgagcagctgtatgtatcccatacacaggatgcgatcgattcgctcggcagcgtagatactgtagcagcagcaaccacagcaggagatctggaggacggcacgtacagtgccgtcttcgacactgacagcagtatgttccatgtcaatgaggcatgtgccggacgcggcacacttaccgtcaaggatggcaagatgaccattcacgtaagtcttgtgtcacagagtatcgtaaatctgtatccgggaaccgccgaggacgcgcagaagagcggagccaagctgcttgagccgacgaaggataccgtaacctacagtgacggaacatccgaggaagtgtacggattcgatattccggtggaagcactggatcaggaatttgatctggcaattattggaaccaagggtgtgtggtacgatcacaaggtgagtgtatccgacccggttgcggagtaagagatgaagaagaaagtaacagaactgatcgtatgcctgctgtctgtgatctgtttcctcacagcgtgccacacgccgcagagcgaaaaactggcggacggaacctatcaggcggacgttacgctcaccggcggcagcggcagggcgacggtggactcaccggcggcgattacggtgaaggacggcaaaatatatgccaccatcgtgtggagcagcccgtattatgattacatgatggtagaggatgagacctgctacaacgaggcagaggcaggagagaactcgacgtttacgattccgattgaaaagctgccatgtgagatctcggtgattgcggatacgacggcgatgagcgtgccgcatgagattgagtacacactgtcatttgcgttaaaagagacggacttttcggaactgacgaagacggggcagtgggatctctcttatgccacgcagtatcgtgtggaacaatacggggagtatgatctgattacaatggctgatgacagccgttttttgctggtgccggagaatgttccggtaccggaacatgtgccggaggatgtggttgtgttaaaacagccgctggatcacacgtatctggtatcctcatcggtgatggatatgatccgtgagatcggagcgctttctgacatccggcttacaggagtaaaggagtcggactggtatatagagaaagctgcggctgcgatggaagacggccgtatgctgtatgctggaaaatacaatgaaccggactatgaactgattttaaaggaagggtgcaactttgcactggagaacacaatgatcggacataatccggaggtaaaagaaaagctggagagccttggcataccggtcatggtggaacgttccagctatgaagaacatccgctcggaagactggagtggatccggttatatggtcttttgtatggaaaagaacaggaagccgatgcattttatgaagaacagctaaaaaaaatagaaccaatcatggaaaaggaagatacaggccgcacggtggcctttttttatatcacggcgaacggagcggtcaatgtccgcaagccgaatgactatattgcgcagatgatcggactcgccggcggcacctacgtcctaaacgaccgtctttcggcggaggagaatgccctgtccacgatgaacatgcagatggaggatttttatgcggcagcgaaggacgccgacatcctcatctacaacagtacgatcgagggggagctttacagtgtcgatgaacttctggcaaaaagcacgctgttttctgattttaaggcggtaaaagagggaaatgtatattgtaccggaagcaatttctttcaggaatccacgggaacctgtgatttcattgaggatctgcacaaggtgcttgtggatgagacagatgataattatcggtttttaaaacacgtgaggtaagaatgaaacgatatgtgatagcctttggcgcgatgatcctgctgcttggcgggttgtttttctttaatatcggttccggaagtgtcaagatgacgggaagtgagattgcggacattctgctgcaccgctttggaggcacggcggatgagacggcgcggcagattgtctgggagatccgcctgccccggatctgtgcggcagttattctggggggagcgctctctgttgcgggatttctgctgcagtcattttttcagaatccgattgcgggaccttatgtgcttggcatctcatccggggcgaagcttgtggttgcgctgacgatgattgcccttttggaaatgggcagggcgatcagttcgctcggcatgattgtggcggcgtttgccggatcgatgcttgcgatggggttcgtgctcttaatttcctgccgggtaaaaaaaatgtccatgcttgtggtatgcggcattatgatcggctatatctgttcggcaatcacggatttctgcgtgacgtttgcggatgactccaacattgtgaaccttcacaactggtcgatgggcagtctctccggaatgacctggtcgaatgtgcggatgatgacagcggtggtggcagtcacgatgggagtgaccttttttctggcaaaaccgatcggtgcgtatcagatgggcgaggcgtatgcgagaaacatgggcgttaagatccgtctgcttcgcgtattgctgattctgctgtcgagtctgctgtctgcctgcgtgacggcctttgccggaccgatctcctttgtgggaattgcggttccgcatctggtgaagacggcgatgaagacggcgaaaccgcttttgctgataccgggctgttttctgggcggggcaattatcacgctgttttgcgacggctttgcgaggacggtgtttgctccgacggagctttcgatcagttcggtgacagccgtatttctggtgccggtagtgattgtgatgatgctgcgcaggaatgaggacaggtaacggaggaacgtgtgatggaacagaggaaaaaagagtctggaatcaggcttgaggatgtggcggcagggtacggcagaaaagctctgcttaaccatatttcgctgcatgtaagtcccggaaacgtcctgacgctgatcggaccgaacggtgcaggcaaatccacgatattaaaaaccgtgaccagacagcttgcagagcttggaggaacgatctttctggaggggacagccatgagccggatgcgggaagaggaagtcgcgcggacgcttgcgatggtgatgacggaacggcttcatccggagtttatgacctgccgcgaggtggttgcgaccggcaggtatccgtataccggaaggctcgggattctctccgcagaagactggaagcttgtggatgatgccatgcagctggtgcatgccagggacaccgcggaccggaatttttcacagatcagcgacggacagagacagcgggtgatgttagcgcgcgccatctgccaggagccgcggattctgattctggacgaaccgacttcctacctggacatgcgctacaagatcgacattttatccagtatccgaagactcgcggcagaaagaaatatggcggttgtcatgtcgctccacgaactggatctggcgttaaaggtatcggatgtgatcgcctgtgtggagggagaccacatcggaaaaaccgggacgcctgaggaagtattttcgggcgattatattcaaaaattatacggggtggatgcagagtgttttgatccgcggacaggcgccgtgtatctgcgtggaaataaaagccgaccaaagatctttgtgatcggtggggctggcagcggcataccggtctatcatgccttacagcggaaaaatgtgccgtttgcggcgggaattctgatggaaaatgatgtggaatatcaggattcgtgtgccgcggcaagccgggtggtttctgtgaagccgtttttcccggtcacagaggaggagatcgcggaggcgagatcgtggattgagacgtgcgagacgtgtgtctgttgtgcggaaacctttggaccttacaacgaagcgaaccgcgcgctgcgcgagtatgcaaaaacactcggaaagctgattcctgcagaggtgctgcatcatttggaaggaacttgaaatggcggttgactgcaggagacggcgtgtgaatttggagacagcaggtgtgccggaacggtgaatgcatcggggagggcatgtgcaccggcggcagagaaagagaggtgcgcgatggagcgtggcatattggtcgtgagctttggaacgacttatcaggagacaagagaaaagaatatcgatcagatggtggcgcttgtcagagagcagtatccgcatgatctggtggaggaggcgtattccagcagcactgtgaggaaggtgttaagagagcgggacggcatcgcgaaagatgatgtgaggcaggcgctttgccggatgcgcgatgccggggtgcggcgtgtgatcgtatttccgacccacatcattgacgggattgagaaccaccggatgaagcaggaggtaacagattgtgcaccgtggtttgaggatgttcggattgcggatgcgctgcttaagacaccggaggattatcagagaacggcggaggctctctgggaatcggtggcggcggaggcgggatcttcgccggtgatttttatgggtcatggaagtgagcatgcggcggatgagagctacgagcgtctggaatgtgtgcttgcacaggtgacagagaacgacgtctatgtggcgaccgtggagggaagcgttacgattgacgatgtgatcgggaggatgagggcctcaaggcataagagcggacgtgtgcttgtggcgccgtttatgctggttgcgggagatcatgccaatcatgatatggcaggagaggaggattcctttgctgccgcactccgcgaggcgggatatgaaccggtttgcctgttaaaggggattggagagtatgagccggtgagagagtgctatttcagacatctgcggcactgcatgggaaccctctacgggatcggcgtgggtcccggcgatccggagctggtgaccgtaaaggcgctccgctgtatggagaagagtgatcttatcgtgcttccggcggaggatcctgtgggatgccatgcgtatcagatcgcaaggcaggcataccccgggattgagaaaaaggaacttgtctgcctgccgtttccgatgacaaaggagaaagaaaagctgcgcagggcacacgaggagatttttgcgcggattgtttcttatcttaccgaaggaaagattgtggcatttttaacgatcggagatccgtccgtctattccacatacggttatatccaccgcagggtcgcggcgtggggcgggaatgttaaaatgataagcggcgtgccgtccttttgcgcggctgcggcgagtcttggaatatcgctcggggataaccgggatgagatccatgtgattccgggatcgtacgaggtggaggagacgatggcgctttccggcacccgggtgtacatgaaatccggaaaaagcctcgcgcggctgaaagcgctgttggaagaacagcagaaggagaagaaactgtccgtctactgcgtggagaactgtgggatggcggatgagcggatccgcctgggagcggaggcgctcgaggagaacggaagctatcttacgacgcttattgtcaaagatgagggagaggtggtataatgacagagaattcatatcgctttttttccaaccgggaatgtcagtattatccgtgccatgagggcattgaggagatgaactgcctgttctgctattgtccgctctatgagagacgtcattgtccgggaaagccagagtatattaagagcagacgggaggatggaagcgaagtacagatcaagtcctgcatgaagtgcacgtttccacatcaggcggagaactatgatgtgatcatgcagtttttgaggaagggagatagataggatgaagagagtatttttgattgtattggacagcgtggggattggcgagatgccggatgctgcagattacggggatgcgggaagcaacaccatcaaagccgcttccatgagcccttatttttccatgccgaacatgagaaagcttggcttttttaatatcgacggcgtggagatcggggaaaaggaggcagctcctgccggagcggttgcccgcatgacggaagtgtcaaagggaaaagatacgacgatcggccactgggagattgcaggcgtcatctcaccaaagccgctgccgacctacccgaacggtttcccgcaggagattattgaggaattttccaaaaagacaggaaggggcgtgctctgcaacaagccgtattccggtacggatgttatccgcgactatggggaggagcatcttaagaccggcgatctgatcgtgtatacatcagcggattctgtgtttcaggtggctgcacatgaggatattgttccggtggagaagctgtatgaatactgccagatcgcgcgagatatgctgcgcggagagcacggcgtcggccgtgtgatcgcgagaccgttcaccggaacgccggggaactttacccgcacgacccgcagacatgatttttccttacagccgccgaaagtgacgatgttagaccagctctcgggagccggttttgacgtgctttctgtcggtaagatcatcgatattttcgcggagaagggcatcacggagtatgtccgcacgaccggaaatgaggacggcatcaacaagacgcttgattatatgaagaaggattttaacggactgtgctttacgaatctggtggattacgacatgctctacggacaccgcaatgatgtcgagggctacgcaaaagcactgacgtacttcgatgagcgcctgccggaacttttagcagcgatgggcgaggaggacgtgctgatgatcacggcagatcacggctgcgatccgagtacaccgtccacggatcattccagagagtacacgccgcttgtgatgtacggagcaccggtgcgggcaggggagaatttcggaacaagaaagagcttttccgacattgcagcgacgattctgtcctactttgatctgaccccggagtgcgcgggcgaggcaattccagtattcaagaaatagtacagatctttggaagagaagtttttgcatttttcatgaaattatgttatagtgccaacgtatgcaaagtttcggctttgctgcgttggcatttttgaagtgatttgttttttggaggatagatagtttggctgatttaagaaaagagattgaaaagagacgtacgtttgcaattatttcccacccggatgccggtaagacgacgctgacggagaagttcctgctctatggaggagcaatcaatctggcgggttccgtcaagggaaaagcgacggcgcgtcatgcagtgtccgactggatggagattgagaaggagagaggtatttccgtcacgtcatcggtactgcagttcaattacggaggttactgcatcaacatccttgatacaccgggacatcaggacttctcggaggatacttaccgtaccttgatggcggcggattctgccgtcatggtaatcgacggttccaagggtgtcgaggcgcagaccagaaagctgttcaaggtctgtgtgatgcgccatattccgatttttacattcatcaacaagatggaccgcgatgcgaacgacacgtttgatcttcttgatgagatcgagaaggagcttggcattgcgacctgcccgatcaactggccgatcggttccggtaagaattttaagggggtctatgaccgcaacacaagagagattatgatgttttccgatacattaaagggaaccaaggaaggtacggagaagcatatttccgtggacgatccggcgctgattgcagagattggacaggatgcgtatgataagctgatggaggagatcgagcttctggacggagcgagcgcggagtttgatcaggaactcgtgacgaagggagaactttccccggtattttttggttcggcattgacgaatttcggtgtggagacctttttgcagcatttcttaaagatgacttactcgccgctgccgcgcaaggcggatatcggagaagttgatccgtttggtgagaatttctctgcgtttgtattcaagattcaggcaaacatgaacaaggcacaccgtgaccgaattgcgtttatgcgcatctgctcgggcaagtttaccgccggcatggaagtgacacacgtgcagggcggcaataaaaagatcaagctttcgcagccgcagcagatgatggcgcaggagcgtcatatcgtggacgaggcgtatgcgggagacatcatcggtgtgtttgatccgggtattttttccatcggagatacactcaccacggcgaagccgtttaagttcgagggaatcccgacgttcgcaccggagcattttgcgagagtgcggcaggtggatacgatgaagcgcaagcagttcatgaagggcatgcagcagattgcgcaggaaggtgcgatccagattttccaggagtacaatatgggaatggaggaggtcatcgtcggcgtggtcggtgtactgcagttcgatgtgttgaaataccgcctcgagaatgagtacaatgtggaaatccgcatggatacgcttccgtatgagcatatccggtggattgagaatgaggacatcgatatggataagctggtcggaacctcggatatgaagaagattcaggatctgaagggcagaccgctgttactgtttgtcaatgcatggagtgtcggcatggtattagaccggaacgaaggtctggtactctcggagttcggcagggaatagagcgtgtgtcagagcagctgccggcagaaaacagtgccggcggaatgcacagaaaggaagcagaatatggcagttgttacaattacaaatgaaaattttgaggacgaggtgctggcggcaaaggtgccggtcattctggatttctgggcagagtggtgcggaccgtgtaaaatgcagtcgccggtatttgaggcgctgtccgaggagcttgccggaaaggtgaagttcggaagcgtcaatgtggacgagcaggcggcgcttgcgttaaagtatcaggtgatgagcattccgatgctcgttgtgatgcagtacggcatttttaagaaaaaagcgatcggactgcagacgagagaggaaatcttagatctgcttgcatgctgcgaagcagaatagataacaaagcgttagagaagggaattgccgcaataagcatagagcttttgggcgataagtaatattatcagaagatcacaccgtgggatttcagatgaaaatgcagatggaaattcggttcaaaaaatgtggaatttctaaccagccgaatgtttgcatcttcgatgatccgtgtctttccaagtttggagcactccgcgggtcatgtccgcatcccggaagacaatttgtaggacttttgtgtgtgtcccttattggcaccagacaacaggtggcataaatgccacctttatgtcgaataaaacataaccgcgcgaaaccgatgtctgagttgccatctgccctattttcaatagcagatggcaacgagtttcggttcgcgcggttttatatcgtctgtgaagaggtgccattagggacaccagaaagtccgcccattgtctccggtgtgtcggacatgcccccgtcggattgtccaaacgtggaagagacacggaatccgatgcaaacattcagccggaagaaatgctcacatttttctcaaacgaatattccatttgcatttccacatgaaatccccaagtgcgtttcttataatattacttatcgatgcaaagcgagctatgcttattgcgacagtccctttaacggttttttacggtgtaagcggctttttctgagtgcatttccatgagaagacgtggaatcgtccatccggcgtttgtgggcgtgagtacagccttgtagtcgatgggggcgtcgatgcggcgcagttcaaacagcagcttgtccatccggcgctcgggcagctggcacatgacgagcagacggtcgcgggagacggctgccggagtgctgccggcttcgggtatgccgcaggcagcggaaacggcggaggcaccggcaggggcatctgcgcctaaagcagccgtgaggctggcggggacaggtgtgccgggagcggcggggatgccggcaggaaccgcccggccggatgcgattgcgccgagcgtattgtggtacatcgaaacgggaatctgctcgcagtgcagtttcagccgggatgcaaccggttttatcttttgaaattcagcgtcggtaagtccgaagaacaacagtttttccatagatacctccagaaatcagatcgtagttttgtcagaggtcattataacacagatttgcaggaatacaacgaaaagcaatgtgagaaaatgtccggttttccggtaatttgtgattgcggatatggggcggatatggtagtataaggcatacccgttttttggaggggcgtctttttatcaaatcatgcaggcagggaagtcctgctgtgcaatcagggctgctggagcggtcatcaggcggtatccgccacggaattcattgaggtgttacttatttttcgggtttgtggttgacattttcccggaagtatactactattagaacagaaaaacgaacataagttcgcaattcgtgcgcggacggttcgcatggaggaaagagaatggctaaggacgataaactgacaagggatgagagacctacgacaaaggaagagaagttaaaagcgcttgacgcggcgatttcacatattgagaagcagtacggcaagggatcggtcatgaagctgggcgataattctgcacacatgaatgtggaggcggttccgaccggatcattgagtcttgatctggcgcttggaatcggtggtctgccgaagggacgtatcatagagatctacggaccggaatccagtggtaagacgacggttgcactgcatgcggtggcagaggtacagaagagaggcggcatcgccggatttattgatgcggagcatgcgcttgatccggtctatgcgaagaatatcggtgtcgacatcgacaacctctacatatcacagccggactgcggggagcaggcgcttgagatcgcagagacgatggtgcgttccggagcagtcgatattgtgattgtggactctgtggctgcgctggtaccgaaggcggagatcgacggcgatatgggagattcccatgtgggactgcaggcgcgcctgatgagccaggcgctccgtaagctgacatcgattgtcagcaagtcgaactgtatcgtcatttttatcaaccagctgcgtgagaagatcggcgttatgttcggtaatccggagacgacgaccggcggtcgtgcactgaagttctattcttcggtgcgtctggatgtgcggagagtggaggcgttaaagcagggcggtgaggttgtcggcaaccatacgcgtgtgaagattgtgaagaacaaggtggcaccgcctttcaaggaggcggagttcgatattatgttcggacagggtatttccaaggaaggagatattctcgatctggcggcggatgccggcatcatcaacaaatccggtgcatggtatgcctacaacggcgagaagatcggccagggacgtgagaatgccaagaactacctgaaggagaatccgctgatctgtgaggaagtggaagcgaaggtacgtgcaaagtacagccctgaggaagatgaggctgcagaacagccggatgagaagagtgcgggaaagacaacaggacgtactccggaagaactgccggcagaataaggataggagtgcaacagacagatcatgcaggaagtccaggtaaaggaagtagccagacgtgagaagggacgggtgtttttccggtttgacaacggaaccgaatttacactctaccggagcgagatccggggactgccgcaggcggagagcatgcttttgatgacggaggatgcgtatctgccggtatcactatatgagaagattctgacggagattgtcggaaagagagccaaaaagcgtgcactgtttctgctggagcgcatggaccgcacggagtcgcagctctgtgaaaagctccgccagaacggttatcccgaggagtgtgttgcggcggcggtggagtatgtaaagcagtatcactatatcgatgacctgcgttatgcgaagcagtatatccgctatcaccagcagaagaagagcagccagcgcttaaagatggacctcatgaaaaagggggtagggcgggagcagattgagcaggcactcgcggaggagtttgtgtcggatgagcgggcacagattgcggagcttttagagaagcggcactacgatgcggcgcaggcagaccgcagggaacagcagcggatgtatcagttcctcatgaggcgcggttttaagagcagtgatattcttgcagtgatgcgcgaagagcattttttcgacgaattttaaaataaatttcagtacaatatcttgtatttttgtaaaaatgaaatgcaatattatgcatattgtacagttattcacttgacataattcatgaaatagaataaaatttatgtgttgtaatttatgacagataacgattatatttttatgttatatgtgttatatgtacaatgaaaacttaataaaggaggtgctcctgtggagacagtgattgctgttgttgttgctatcgcagtgactgccatcgtggtctattttgttacatctgcttaccataagaaggtgacggaagccaagattggaaacgcagaagagaaggcaagagagattattgatgaggcggtgaagacagcggagaccaagaagcgcgaggcaatgcttgaggcgaaggaagaatccattcgtgtgaagaacgatctggataaggaagtaaaagaacgccgggcagagattcagcgcagcgagcgtcgtgttgtacagaaggaagagaatctggacaagaagcttgagtcaatcgagagacgcgaagcgggttttgctgcaaaggaagaagagatcaacaaacagaaagcgcaggtcgcaaagctcaatgaagagcggttacaggaactggaaagaatctccggattaacctccgaacaggcaaaggaatatctcttaaaaaccgttgaagaagatgtaaaacttgatactgcaaaattgatcaaagaaatggaacacagagccaaggaagaggcggacaagaaggcaaaggaatatgtggtaacagcgattcagaaatgtgcggctgaccacgtcgctgagacaaccatttcggttgtccagcttccgaatgacgagatgaagggtagaattatcggacgtgagggacgtaatatccgcacgctcgagacactcaccggtgtggatctgattatcgatgatacaccggaggcagtaatcttatctggatttgatccgatcagaagggaagttgcccgcattgctttggagaagctgattgtggacggacgtattcatccggccagaattgaggagatggtcgaaaaggcacagaaggaagtcgagacaatgatccgtgaagaaggtgaggctgcaaccttagaggttggagttcacggaattcatccggaacttgtccgattgctcggcagaatgaagttccggacgagttatggacagaatgcattgaagcattccatcgaagtagcccagttatccggattgctggctgctgagatcggtgtggatgtcagaactgcaaaacgtgcaggtttactgcatgatatcggaaaatcagtagatcatgatatggaaggttcccatattcagattggtgtggatttgtgtagaaagtacaaggaatcaccgattatcatcaatgctgtggaagcacatcatggtgacgtggagccggagtctctgattgcatgtattgtacaggcggctgatacgatcagtgcggcaagacctggagcgagaagagagacattagagacctactcaaacagattaaaacagttagaggatatttcaaacggatttaagggcgtagagaagtcatttgctattcaggcaggcagggagattcgagttatggttgttccagaacaggtcagcgatgcagatatggtattgatggcacgtgatatttccaagaagattgaagcggaaatggaatacccaggacagattaaagtaaatgtaattcgtgaatcgagagtaaccgactacgcgaaataacaaagagagcagagaaaagttgtcgcataaccgagaaatcgtgaagcggcagcttttttcatttcataggaaataccgtgccgccttcatgtgtgaatgcagaaccttcctatgaaataaaaaacgctccgcgaggatgcgcagctcgcggtaaggaaaatatcgctttgcaaaccgctcgcgcgcggagaatctcgcaagcgagattctttttcataggaaataccgtgtgatgttaaagcgtggaagatgtttcctgtagggcaaaatgcttcgcggaggccgcattgcggcgaaggcggggatgttatatcagatgcagaatagaaaggatgggtaatatggatcagcaggtaaagagagtcaagagagaactaataaaacatggtgcaattctggatatgtatgaggataccatggaacttccggatggaaagcaggagacatgggactttatctcacaccgcaagggagcggcggccgttgtgccggtgcgcggggatggaaagatcctgatggtaaagcagtaccggaatgcgatcgaccgcatgactctggagattccggcaggttcgcgcgacagcgtgacggaggataccagggtatgtgcagcaagggaactggaggaggagaccggctattgcagcgacgatctgaccagaatcttatctcttaagacgacagtcgcattctgtgacgagtttattgatgtctatctggcaaaaaatttaaagcccggacatcagcatctcgatgagggggaatttattgatgttgccgcctacggggtggatgaattgtgcgatatgatctatgcgggaaccatccaggatgccaaaacggttgccggaattttagcatataagaatctgctgaatcaggactaggagatccgcataaatataatacagaaaagatatgagcggagtgcaatgtttgaagcgggaaggatgtattgtgatgctggcatttctgggcggaattgttctgaccaatctgcttggcgcaaatcggcagatacatggacaactgctgaatcagacatttctgcaacagtatgcttatcaaaaagtggatgggaatcagctgtttggtcatgtggttatggtgcgcatgcagatgctggttctcatctttttgcttggaagagcggttgacggaaaggtgttttccgtgctggcaaagagcatgctctcagcaggattcggattcttgcttgttgtcggaattatggaatacggaggatatggctgcctgatcattcttgccggattgctgccgcagtggattttttatacggcggcgctgcttttctatgcgaacagtaagaaaagacagagcagaatcgtgggatggaacagctggcaggatcggacgcggcagctggcggaagcggggcttgtgacaggctgtgtgttattgggaacgtttgtggagagctttgtcaatccggcagtattcgcctgggttttaaaaattttttgctaaaatttttaaaatgattacaatatatggtacggagaaaataagggaaacgagatgttgtagtttcgctctaaatgcccgaattataagggaaaaatgcgattgcttttcggtttggttctgattataatgaatgatgtaccgcgtttgcggtacatttttcgacagagaagaaagccgcatacagcggagcaatgcagtgaacaaatgagtggcggggcaggtaaacgttatgacgcaggacatacagaatttcattcaatatttacatcaggagaagaatacctcagagaacacggaggtttcttatgcgcgtgatttgaagaaaatgaatcagtatcttctggcacagggaatctgcgatgtgaatgaggtgacggctacaagtctgacatcctacgtcatctatctggaaaaggaaggaagaaagcctgcgacgatctcgcgaagcattgcgtccatgaaggcgttctatcattatatggagaaggagcggagactggcagtagatccgtccgagcgtttaaaggcgccgcggattgagaagaaaatgccgacagtattgacgacggaagaggtgacgcgccttttggaacagccgggaggtacatcgccgaaggaactgcgggataaagccatgctggagttattgtatgcgacaggcatccgtgtgtccgagctgatttcactgagggtgtcggatgtgaatctgcggatggagtatctgacctgctcggatggacataaggaacggatcattccgtttggaatgattgcgcgcaaggcgctggaagcttatcttgcagagggcaggccgaagcttatatcagatgagaaggaagaccgcctgtttacgaactgttccgggcagccgatgagccgccagggattctggaagctgatgaagggctacggcaaaaaggcgggaatagaagcggagattacgccgcatatgttgagacattcctttgcggcgcatatggtcggcaacggggcggacttaaaatcggtgcaggagatgctgggacattcggatatttccacaacgcagatatatgcgcaggcgaaagatctgcagatgcgggaggtttatctgaaggcgcatccgcgcggataagaagacgggatataaaagagaatatataatagaaaaagaatataaaaaagaagatagaaaagaacataaaaagaggtgcagccacatggtttgtgtggttgcacctcttttgtttcataggaaataccgtgatacattcatgtgtgaaagtagaaccttcctatgaaataaaaaacgctccgcgaggatgcgcagctcgcggtaaggaacatatcgctttgcgaaccgctcgcgcgcggagaatcccgcaagcgagattctttttcagaacgtgcgttagcggcacatatctgcaatggtatagatcagatctctggaatcctcccagccaaggcacgggtcggtgatggatttgccatagatgtgatcgccgattttctggttgccttcctcgatatagctctcgatcataacaccttttaccatgtgttcgatatcggaggaaacctgtctgttgtgcatgacttcctttacgatgcggatctgctccttgaatttcttgccggaattggagtggttgacatcgaccacagcagccggattgacgagatccatttcctggtacatctcgcagaggcggatcagatcttcgtagtggtaattctgtgtggtgttgccgtgcttgctgaccgcgccgcgaagcacaacgtgtgtgagcgggttgccggttgtctcgacttcatagccgcggtatacgaagtggtgtgggtgctgtgcggcgtagacggaattgagcatgacggaaaagtcgccgctggtcgggttcttcatgccggaagccacatcaaaaccgctcacggtgagacggtgctgctgatcctcgacggaacgcgcgccgatggcgacataggacaacaggtcttccacatagccccagttctccgggtagagcatctcgtcggcgcaggtaagaccgctttcctcgatcgcgcgaatgtgcattttgcgcatggcgatcagtccctcaatcatgtccggcgctttttccggatccggctgtgaggcaatacccttataaccttcgcctgtggtgcgtggtttgttggtgtagacacgcggaatcagaatcagcttgtccgcaacatcctcctgaatggaagtgaggcggctgacataatcacagacggaatcttcgttgtccgcggagcaaggtccgatgatgacgagaaaacgggaatctgctccggtaatgacggcgctgatcgcagcatcacgctctttttttaacgctttcagcttgtcggaaagcggatagttctgtttgatttcggccggtgacggcagttcgtttaaaaatgtaaaactcatatgacattgtgtggataaggaaaaagacaccgcacactcctttctgtttgaatcgtaattatcttagctgatattacaatagatgtcaaatatttgcatatttattcagaatggagtaaactgtaaaaaaagccgtacatggaagtggtccggatgaaaaaatgcaggtatggaaagggagcaggaacatgaagccattggagataaaacaccgtgtgattgggagaggggaaccgttgatctgcgttcccgtggtagagcaggatgcacagtcggtgatccgggagatcacgtatctgagtcagagcaccgcggatatgatcgagtggagagtggatgcattccgcgattttacagattacaattcaatccggagcgtatttgaggctgtggcgcctctgctgggggagaagcttttcctgtatacattccgtaccgcgcatcagggaggcatggcgcaggtgaaagcggaacagctcgacgatctgcacgatcttgcggcggaatccggctgtgtcgatctggtggatctggaattctttgaggaagaccgaccgctccataagataaaaaggctgcgggagatgggagtgtcggtcattgcctcacatcacgattttgagcagacgccgtctccggaagtcatgaagatgctgctggagaaaatgtgcgccggcggagcggatattgtaaagcttgcggtgatgccgcagaattataaagacgtgctcaatctgctggatgtgacggcacagtttagagaggagaatccggatacgccggtgattacgatgtccatgggatcactcggcggcatcagcaggatcagtggggagacgttcggctcctgcgtcacattcggcgcgcacgaaaagccgagtgcgccgggacagttcgccatgaaagaactcagacagatgctggatacgattcatgccagcagccagatacaatagaattattaaaaaaagataaacacagggagattgcttgacgcagcaatctccctgtgctattataatgtcccaaattatgtaacagtgttaataattaacaaggtggtgaaatatggaagaattgtatgcgggtttatttcgggcgatgaaccgtttcggaaaactgcggatcggagaactgttttccgatatgacaaaaagcgacggcatgatgctctgggcaatttcacagttgaaccaggaaaagaataatgggagagctacagtgtctgaactggcagagaagcttcatacccagaattctgctgtgtcaaggactttgaagaatctggaggatcacggctggatctgcagaatgacagatccgaaagaccggcgcaatacctgtgtcgctctgacggagagtggggaggacatgcagcaaaatatgacatgcaccatgcaggaatttggcagggcagtcatttcgcagatggatgaacaggatctcaaaaagctcatagtatgcctggatgaattatatgacattgcagcagaagaaatcgagaagagaagtatgcgaaacagaaaggaaggacaacatgggaaagatttttaaaaatatgattccatactggaaaccgctgatcctggtgttattgctgttgtttgtgcaggcgtggtgcgatctgtcactgccggcatacacatcggacattattgatgtcggaattcagaatcagggaataaaacacatcctgccggaggcattgacaccggaggagtatgagaaggcagaacttttgatgacggatgaagagacggcatcctgggaggaaagctatgcgttaaatggcagtgtgtacgagcggaatgtgaccggggaagaacggctggaggaactggatgatacgtttctcgtaccgcttcttatgaattatcagatgtctgctatggaggaaagtacatttaagaaactgatggcagagcagatgcatacagatgagtctgcgctggacggaatgacgatcgagcagatcggcgcgtccatgggcgtggaattaaaaacatttgaaaaagagacgcagaacgaggacggaaatacgacgacagtcacctgtgtggatatgagagatctgctgcaggcgatggtatccggcggcatgctggaaaaagaccagcttttatcaatgcgcggggaactcaactcgatgctcgatgccatgggcagttcgcttgtcaaatcgatgggcgtggcgtacgcggcaggctgcgatgcggcggcaggcgtggatgtggaagcaattcagaagtcttatctgtggaaagccggtttgaaaatggtgggaatggctctgattatggggattgccacggtcttagtcggctttatcggcgcccgcatcggtgcaggaatcggacgtgatctccgcggaaaaatatttaaaagggtggtaagcttttccaatgccgagatggatcgtttttcaacagcttcgttaattacccggagtacgaacgatatccagcagattcagatgacatgcgcgattctgatccgtatggtagcttatgcaccgatccttggaatcggcggaatcttaaaggtactgcagaccggtgccggtatgggctggatcattgtgcttgcagtgcttgtaattctgggatatgtgatggttctgatggcggttgcgatgccgcgttttaagctgatgcagaaactggtggaccgcatcaacctcgtggcgcgtgaaatcctgacaggactttcggtcatccgggcgttcggcagggagaaaaaagaggagcagcgttttgacgatgcgaaccgcgatctgacgaaaaccatgctttttacaaaccgcgtcatgacatttatgatgccgggaatgatgatgatcatgaatgtgcttacggttggaattgtgtggttcggcgcacataagatcgatcagggaactatgcaggtcggctccatgacggcgtttatcacgtatgcgatgatgattgtcatggcattcttaatgctcgcggcaatgtcgattatgcttccgcgtgcggcagtggctgcggagcgtattgatgaggtcatccgcacgcagtcttcgatcgcggaaccaatgcagccggagaaaattaaagaacaccgcggcgtgatctgtttttcccatgtgaacttccgctacccgaacgcgcaggaggatgtgctctcggacattgactttgttgcggagccgggaaagacgacggcaatcatcggcagtaccggctgcggaaagtcaacactggtgaacctgattccgcgtctttatgatgtgacgggcggaagcattaccatggacggcattgatatccggaagcttgccatggcagaacttcgggaggagattggttttgtaccacagaaaggagtactgttttccggtaccatcgcatcgaatttaagattcggcaaggatgatgccaccgatgaacagatccgggaggcggcagagattgcgcaggcatcggattttatcgcggagaaaaaagaaggatatgacagtgccattgcacagggtggaagcaatgtgtcgggaggccagaaacagcgccttgccatcgccagagcgatcgcaaagcagccgcaggtttttatttttgacgacagcttttccgcactggatctgaagacggatgccgcactgcgccgggcacttgccaaaaaggttgtcgacaagacggtgatcatcgtcgcgcagcggatcagcacgatcctgcatgcagatcagattctggtattaaacgatggacgcattgtcggaaagggaacacacgaggaactgcttcgcggctgtgaaacttatcgtgagatcgcgagatcccagatgtcggcaaaagagcttggaatggaggaacaggaggtgtctgtgaatgagtaacggaaatgagacggcaaaaggaatgggcagacgccgtggaccgatgggcggacgcggtatgacgccgggagagaagccgaaggatttaaagggagccatcggaaaactggcatcctatatccggcattttaagtttgcaatcgttattgttgcagtatttgcggcgtgctccacggtgttcagcgtaatcggaccaaagattctgggaaaagcgacgacagcgctctcggaaggactgatggcgaagatccgcggaacaggcggaatagattttacttatataggaaagatcctgctgtttgtattggggctgtatcttctcagtgcactgttttcgtttgtgcagggctggattatgaccggggtgacccagaagatctgttaccagctccggaaggaaatctcggagaagatcaaccgaatgccgatgaagtattttgagagccgtacctacggtgaggtgctttccagaatcaccaacgatgtggataccttaggacagggactcaaccagagcattaccacgatcattacctcggttgcgacactgatcggtgtatttatcatgatgctcagcatctcgccgctcatgacgctgatcgcgcttgtgatcctgccggtctccgcggggctgatttccttcgttgtgaagaagtcgcagaaatactttaagaatcagcaggaatatctgggacatatcaacggacaggtggaggagatttacggaggacatctggtcattaaggcatttaacagagagcaggatacgatcgaggagtttgatgcgacgaaccagaagctgtatgaatcggcatggaagtcacagtttctctccggtatgatgcagccgatcatgatgtttgtcggaaatctcggatatgcagccgttgcgcttagcggaggtctgcttgctatccggggaacgatcacaatcggagatattcaggcgtttatccagtacgtgaaaagtttcacacagccgatccagcagatcgcacaggtcatcaaccaggtgcagtcgatggcggcggcttcggagcgtgtgtttgaattcctgaatgaggaggaagaagaccagtccgtggagaatccttgtgatatttccaaggtgacaggcgcggtatcgtttgagcatgttcatttcggctaccagccggatcagacgatcattcacgacttcagcgtaaatgtggctccgggacaaaagattgccattgtcggaccgacaggcgccggaaagaccactatggtcaaacttctgatgcgtttttatgatgtaaacagcggcgcaatctgccttgacggtcatgacgtgagaagctttaaccggcgggatctgcgtgaggcattcggtatggtgcttcaggatacctggctgtttcagggaacgatcatggaaaatatccgttacggcaggctggatgcgacggatgaggaagtcattgccgcagcgaaggcggcgcacgccgaccactttatccgcacactgccgggtggctatcagatggagttaaacgaggatgcaagcaacgtctcacaggggcagaagcagcttctcaccatcgccagagcaattcttgcagacaacaagatcctgattcttgacgaggcgacgtcgtcggttgacacacgcacggaggtggcaatccagaaagcgatggatcacctgatgaaggggcgtaccagctttgtcatcgcacaccgcctgtcgaccatacgcgatgcggatatgatcctcgtcatgaaggacggcgacatcgtagagcagggcagacacgaagaactgctcaaaaagcagggcttttatgcgaacctgtataactcgcagttcgaggagaccgtggcataagagacggcatgctccgaaagcggactgccgtacggcaaggagggataaggaatattacaggaacacccgggaacagaaagctccggaatagaacggacggcggcaattctgaccgcaaaatccggtatttttaaccacgccgcgcctggcatcttcgatgatctgtgtctttccaagtttggaacactccacggaatgagttcgcaagccggcagacaattttaggacttttgtgtgtgtcccttatgacacctctgaatagaacataaccgcgcgaagccgatgtttgagtcggcatctgccttattttcaatagcagatgccggcgagtttcggttcgcgcggttttatattgtctgtgaagaggtgccattagggacaccagaaagtccgctcattgtctgcagcttgtcggacacactccgtgagtgtccaaacgtggccaagacacgaaatgggatgccggacgtggcatggaagaaatacacgaattttgcttcaaagaatttgctgccgtccgttctatccggaactttcaggtatctgtttttcggaatattcctcatcccccatccttttccgttacggctggcgattacggggacgtgccggatcggacgccgcgtctgccggatgcgctgcattgcgcttggcgcgctgcatgccgccggtcatgtgggagagcgcgggcgctgcatcgtccgcttcgataaagcaggcgcgcttgatggaatcttccccgtagcgggagcggatggcgtcgaccgccacattcaggcgggagagcttctcgttcttctgcatgtcaaacaggtcgtactgctcgtagtgttcctgcgtcgccttgccggtcgagacgccgagcagccggattggacggtgatcccagagctcgtcgaagagctcacaggcacaggtgtacagcttctccgtgacgttggtggaggaagcaagcgttacctgtctggaagtgtggcggaaatcattgtccacaatctgcacctgcaccacgctgacataggcgccggcagcgcggattctggcaccgaccgtctcacagagcgagagaagcacatgctttgccaccgcggtatccgtcacatcgtactggagcgtgagggaattgccgaatcccttgcttgcggcgtcgttgtgggacagcggtgtggattcgattccgttggcataattccagatggtgtcgccgtgggatttaaagacggagagaatcatggcgtgatcgcttttggccagctggccgatggttgtgatgccgagggagcggagccttagggcggtggatttcccgacgaaaaacagatcctcgatcggaagcggccagaacttttcttccatttcggatgggaaaagcgtgtgtactttgtccggtttttcaaagtcggaggcagtcttggcgagcagccggttggaggagatgccgatgttcacggtaaagccgagccgggtgtgaatctcgtccttcagcctgtgggcaaagtccaccggattgccgtagagcgaggaggtgcctgtcatgtcgcagaaggcctcgtcgatgctgtaggcgtccaccgagggcgcatattctttgagaagtgccatgaactggcgggaacgctccacatagatgctgtagtgcggggcatagatttttaaatcagggcacttgcgccttgcctgggcgagcggctcgccggtacagacgccgagcgcggctgcggagggcgacttggcgagaacaatcccgtgccgtgtcttttcgctgccgccgatgacggaaggaaaagagcggatgtccggggcgtccggatcctggcgcagaagttcggcggcttcccagcttaaaaatgcggaattgacgtcaatgtgataaatgagcggctgcggcatatggtaatcctccttatgatggtgtattatagcagagaagtgaacaaaagtaaatgaaaatacaaacatatgttcctggaggaagaatgaagatccgtatctatgtcatgacacataaaaagtttgagatgccgcagagcccgctgtttcgtccgctccatgtgggacgcgcgtgcggggaagacctgggctatccgggggatgataccggagagaatatttccgacaaaaattgctattacagtgagctgaccgggctctactgggtgtggaaaaactgtcacgatgtggattatgtgggcacctgtcattaccggagatatctgctcggggcggatgagaggattcttatggaggacgattacgaaaagcttttatcagagtacgatctgattacgacgaagcaggttgcactcaataactcctactattacggtttttgcgccaatcataacaaaaaggcactggatgcggcgggagaggtgataaaagaacgttatccggcatattatccggcgtttgagaggctggtgcacggcacaaggacgtatttcgggaatatgtttgtcacgtcgaaggagctttatgattcgtactgcagctggctcttttccatatttgccgaggtggaaaaacggatctgtctggagacgggggaggatgcctaccataagcgcgtgttcggatttatctccgaattcctgctgctggtctgggtgacggtgcagggactttcggtgtgtgagtgcaaggtggggatgatcggtgagaaggcggagacgagagagatgaaagagcagcttgccggctattttgcaagacgcgatgtggacggcgccaaggcgtatttccttgagcgcagaaaggagcgcccggacgttttgatggaggcgtcggatgtgacgggagaactccggctttgcatgcaggtgatcgcaacggcgggaatggagcagacacgttacgggacgaaccttttagaacgcgaaaatcgtttcaaagagctgatgcagatgtttgaccgtctggaccagatcgtgtaccgctaccgcaacggtctgcagaaaaaagaggatgccgtctttttaaaggaacagggaatcacggacaccgcgcttctgatcgcactgcggatcccgggggatgatgcagcgcgccagaaggaactgtttgcacagattacggcagacaaaaaagcactggatggcaccaccgcagataccgttactgtgtgagttcacacaattttcagaaaagcttttgggataagcgttgacaaacaaaatgccaatgtgctagtatatgttcgttgcgatatgagtttttcagagatgcgcaatgggcaaccgtagtctaatggatagaacaccggactccgactccggcaatgcgggttcgattcccgccgggtgcatttttttgacagatatggcagagcagattgctctgccatagaatattagagaatctttgacaggcgagagactgtcagattggaacatctgtgcctgcagatatgcacacagatgatgcggtagtgcagcggatgacgaattgtttgggaaaggtacggtggagaatcaatggagaattccagtttgaatcatacagagaatcataagacagaggagaaggagacgaagagaacgccgattaagcagagaaaaaaggagaatgaggttctccgatttatccgggagcacatccggtattttgcggcgggagcgctggtggtcgttttaatcctcgtgcttgccatgtgtgcgaagccgaagggatccgactctgatgtcgtggtgaatgcgaacgcgacggagagcacgcaggcgacggaagaagcctatcaggtggatgccaatgagaatatcaacgcactgattacacagtattacacggcgtatgcggcgggagatgttacgacactttcctcgattgcaacaccgatttctgcaaatgagcagagctacatcggattattttcacagtatgtggatgaatatcagaatatcaagtgctacaccaagacagggctggatgcgaactcttatctggtttccgtgtcgatggagatcaagtttacgggagtggataccacagcgccgggactggatttcttctatgtccgtacgaacgatgacggcacgctttatattgacaacctgtacagccagtacaaccttgccaatcaggagaatgcgcttgacaccagcgtacagagcctgatcggtcagtttgagagcgagtcggatgtggtggagctgcagagtgaggtgcagacgagatacgatgaggcgcttgcagcggatgagaatctggcgaatatgattcagacgacgattcctgcagcaatcaaggactgggtgagccaggtggcggcacaggcggcaaccgagcagaccgaagcgaccgaggcggcggaacagccggagaccgagcaaccgcaggagacagagcagcaggaagagaccgtacagcagacagagacgcttgcgacgaaggatcgtgtgaatgtccgtgccgcagcggatacggaatctgaaaagctcggcaccttagatcagggaaccgttgtcacccgtacagcggtggacggcgactggagcgtgattgattacaacggtacgacaggttatgtcaagaatgagtttttgacctatgatctgccggatacgacggcggacaataattcggacagttcatcggataacagcgacagcacaaacagtgcttccatcgcagagggaacggtgattatgctggagaataccacgaatatccgctcgggaatgagcgaggattccagcaaagtcggaacggcttatgcgggagagaaggtcacagttgtgatgagttatgcggagggctggaccaaggtaaaatggaacggcgagaccggttacataaagacatctttattacagtaagcggtgcggcctggctgataccggaaaacggagactttttaaaaggaagtctccgttttttcacagagagaacatttgaaacggagagattatggacgaacagggagtgcggatcaacaaatatctgagtgaggcaggggtgtgttcaagacgtgaggcggaccgtcagatcgaggcgggggcggttaccgtggacggagtctgcgccagacccgggacaagagtgctgccggggcagacggtctgctttcaggggagaagcgtaagccaggaggaagaacgcatcctgctcgcgtttcacaagccggcgggaattgtctgcacagcggaaaaacgcgagaaaaacaatgtgatcgactatattcattatccgaagcgcatctacccggtcggaagactcgacaaggactcggaggggctgcttcttttgacgaatcagggcgatcttgtgaacaagattatgcgggcgggaaacatgcacgagaaggaatatctggtgacggtgaacaaaccgctcacggagtcttttctgcgcggaatggcaggcggcgtgccgctcgtggaactgaatgcgacaacacgccggtgctttgtggaacgcatcggcaagcgcgagttccggatcattttaacgcagggattgaaccggcagatccggaggatgtgtgaatatttcggctaccgtgtggaaaagctggtgcgcgtgcgtattatgaatattgaattgggcagtttaaagagtggaacataccggaatgtgacggaggaggagtatcacgaattgctccgcctgaccgcggattcgtccagcgatccggtgatgcctgcaaaaaagacgggggagaaaaagagatgacaccggaagaacagatcaaaaacctgcgggaacagattgcgtatcacagtgaccgctattacaatcaggataatccggagatatccgattacgagtttgaccagctgatgctggaattaaagcggctggagcgggaacatccagagctggtcacaccggattcaccgacccagaaggtgggcggcaccgcgaagcggacggcgggtgtgctggtaaggcacaatgtcccgatgctaagcctgcaggatgtgttctcaaaagaagagatctacgattttgtggcacagatgaaagaacagctggatgatccggagtttgtcgtggagtataagatcgacggactttcgatgacgctgcgctatgagaacggggagctggcgctcgcggagacgcgcggcgacggcatcaatttcggcgaggatgtcacggcgaatgcaaaggtgatcggcgacgtgaaaaagaagctccgggaggcaccggagtatctggagatccgcggggaagtctacatgaagaatgcggattttgatgccgtgaatgaaaaacaggagctgctcgggaaaaagccgttcgccaatccgagaaactgtgcggcgggcacgctccgccagctggattccgcgatcacgaaagagcgtaagctgtcgctgtttatatttaatatccagcaggtgcggggaatgcagtttgacacgcacacacagggatatgaatatctgaagaaacagggaattcatgtgattgacgattaccgtgtctgcaagacggcagatgaagtgtgggaggcgattaccgccatcggcgagaaccgcggcaacctcggctatgacatcgacggagcggtggtcaagatcaaccgtttctcggacagggagaagctcggggcaacctcgaaagtgcccagatgggcgatcgcctacaaatatccgccggaggaaaaagagacaaagcttttggacatcgaactgtcggtcggaaggacaggcaggatcacgccgactgcggtatttgagccgatacggctctgtggaacgagcgtttcgagggcgacgcttcacaatcaggactttatcgatgatctggatgtcggaatcggggacaccatcgtcgtctacaaatccggcgagatcattccgaaggtgaaggaagtgcggaaagaaaagcgcccggagggctggaagcgctttgtgataccggatgtctgtccggtgtgcggggcgaagacagagcgggaacgcgatacggcggacatcaagtgtacatcgccgaactgcccggcgcagctggagcgccacatcatcaattttgtcggaagagacgccatggacatcaaggggttcggaacggtttatattgaagaactcgtcagaatgggttatattaaaaatgtcgcggacattttttcgctgaaggagcaccgagaggaactgattgcacagggaatcatcggcaaggagaagaacacggacaagcttctggaggcgatagaaaaagccaagcagaatgatgcgtacaagctgttgaccggtcttgggataccgaatgtcggaaaggcggcagcgaaggcgatcatgaagcattttaagaccatggagcggctttcggaggcatccgaggaggaactgacggcagtcggggacatcggaaaagtcagtgcggactgcatccggagttatttttcggatgcgaagaaccaggtggtgctgcagagactcgcacaggccggcgtcaacatgacggcggaggagagcgagaccgtggactctgtcattagcggaaagacccttgtgttgacgggaaccctgccgacgcttggcagaaaggaagcgcagacgttgatcgagcggtatggaggaaaggtatccggatctgtgtcaaagaagacggattatgtcctcgcgggggagagcgcgggaagcaagcttacgaaggcgcaggaactcggcatcagagtgatcagtgaggacgaactgtacgacatgctgcagatagagaggtaacatttttatgccaatcagaatacagagtgatttacctgcaaaggaaatactggagaaggaaaatatatttgttatggatgagaatcgtgcgatgcatcaggacatcagaccgatcaagatcggaattttaaatctgatgccgctgaaagaagagacggaactgcagcttctgcgttccctgtcgaacacgccgcttcaggtcgatgtgacatttgttgcggtgtccagccatgagtccaagaatacgtcgatgagtcatctgaataagttctacgagagttttgcggatattaagagacgctattttgacgggctgatcatcaccggggcaccggtggagcagatggaatacgaggacgtggattactgggaggagatctgccagatctttgagtggacgaagagccatgtgacgtccaccctgcatctgtgctggggggcacaggcgggaatgtactatcactacggtctgaaaaagtatctcctgtcgcagaaaaaattcggtgtctacgaacaccgtgtgatgaaccggaaagtgccgctggtgcgcggttttgacgattactttatggcgccgcactccagacataccgaggtgcgcacggaggacatccgcaaagtcaaggaactgaccattcttgcggagtccgaggaggcgggcgtattcctcgcgattgcggacgagggcagaagaatctttgtgatgggacatccggagtatgaccgctacacgctggataaagaatacaagcgggacaaggagaaggggcttcccattgagccgccggtcaactattatccggacgatgacgatacgaaaaagccgaacctgcagtggcgctcgcacggcaatatcctttacagcaactggttaaattactacgtctatcagcagactccttatgagttcattgatacggcggagattataggaaagtgatgcggcgtttgccaaggcacggaaaagaggacataagatggcagatacaatgaagatggaatacaagattttcctggaggcggaggacgtgtcgcagtcgcggatcctttcctgtgcttcctacatgaagcgtgtgttagagagctgtaataatccttatatcagcagggcagaacttgatgacgagagcgatctggatgattttgtgctgcgccttttcgtggaggaggagatcgaggagaaggagtgcaccaacccggcgatggcggagagctttatcgaggatatggcggagcttgtgacggggattgctgaagcacattcgtttctggatctggagggaagcttttctgtcacatggaagggaacgacgagcgcatatgcctttgtttccccaggcggtgatgacggatgtgattttcaggaactcggtgtgaccgaataatttaatactttttttggtttccaaaacgggaatagtctgttataataaacgcataatatcacttaggaggcatttgacatgggtgaggatcgcaaaacatttaaaataaaggacggtaatttgggagaagtgaagattgcagatgaagtggttgccatcatcgcaggacttgccgctaccgaggttgagggcgttggttccatggctggcaacatcacaaatgaactggtaagtaagcttggtatgaagaacctttccaaaggaattcgtgtagaagttctcgacggaaaggtaagcgtggatgtggcactgaacatttcatatggttattcgatccctgaagtgtcagccaaggtgcaggacagagtcaagaatgcgattgagaatatgaccggtctggaagtatctatcgtgaatatccgtatcgcaagtgtggacatgggcagcaacaagtaacgcatcgaatcacggtgaataagataaaggatgtccctgcgacatccttttttcctgtacagggaaatgtgacgaagaagacggggacatgagagaaaggaaaggtttatgaccagaagagagttgagagaacagatatttaagctgttgtttggcgtggagttccatgacagacaggaactgccggagcagattgccgtctatgaggagacggaggagccgtgggatacaaaggacggcgcatacatctccggcaaatgcgaggatatcgtggcacatcttgcagagattgacgaggcgatcgatgcggtggcggaaggctggaagaccggacgtatgggaaaggtagatctcacgctgatccgcctggcagtctatgagatgaagtacgatgaggatgtgccggtcggcgttgccatcaacgaggcggtggagcttgccaaaaagtatggcaccgatgagtcgcctgcatttatcaacggtgtgcttgcaaagctggtatgagaaaaaatatctattctgtcggtcaggtaaatacatatatccagaacatgtttgcacaggattttatgctgcaccagatcagtatcaagggagaagtatcgaactgcaaataccactccagcggtcatatttattttaccctcaaggatcagacggggacgatcgccgcagtcatgttttccaggtaccgccgcggactggcctttcagatgaaggagggcgataaggtcgttgtgaccggctccgtggaggtgtacgagcgggacggaaagtaccagctctatgccagagagattgaacttgagggcgccgggaatctctatctgaagtatgaggcgttaaagcgcgaactcgaggagatgggaatgttcgatgcggcatacaaaaagccgataccaaggtatgccacgaggatcggtattgtgacagcacccacgggagctgccatacaggatatccgcaacattgcagccagaaggaatccctatgtgcagttgatcttatatcctgcgctcgtgcagggggacggcgccgcagcaagtattgtgcgcggcatccatgcactggatgtgctgggtgtggacgttatcattgttggacgcggcggcgggtcgattgaggatctgtgggcattcaatgaagaagaggttgcgcgggcaatttttgcatgcaacacgccggtgatttcggcggtcggacatcagacggatacgacgatctcggattatgtggcagatctgcgggcaccgacaccctccgcggcggcggagcttgcagtgtttgatgtgcagctcgtcgaaaagtggctgatggactatggcacgcagatgagacgacagctggaattaaagctgaatcagatgcgcacacgcctcatgcatgatgaggagaagctgcgctatctgaatccgcgcaccaagctgaaggagaatgaaaagcgtttggatgagcttggcgctgccttagagcgccggatgcaggcaatactcgaacagaagcgccataagctggcactcctttcgggaagcctggatggaatgtcgccgcttaagaagatggcacagggatattcttatgtggaggatgccggcggacatgcattgacggatgccggcactgtgcagatcggagaagcgctttccattcatctctaccggggcagcctaaaggcggcggtgacagagatctgtaggcaggatgtcgcagcggatggttcggagaaaggaagaatcgatggataatcagaacgaaaaaaagccgacgcttgaggaggcttttacccagatcgagacgatcctcacgcagatggaggagccggagatttcgctggaggaagcttttgcgctgtatcagcagggggttctgcagcttaagaattgcggaaccattctggatgaggtggaaaaaaagatgcagatcctcggtgaggatggggaaatagaagagatgtaagaacggtagggggatgcagatgatggattttaagaccgagatggcggagcgcacagcgcagattgaacagatcataaaaaaatacctgccaaaagaagaaggctatcagaagaccatcatggaggcgatgaattacagcgtgctggcgggaggaaagcgtcttcgcccgatgctgatgcaggagacataccgcctgtttggaggaagatccgaggtgatcgaaccgttcatggcggcgatcgagatgattcacacctactcgctggtgcatgatgatcttccggcgatggacaatgacgaataccgccgggggaagaagaccacgcacgccgtgtacggggaggcgatgggaatcctcgcgggagatgcgcttctaaattatgcatacgagacggcggcgcgggcattcgccatggaaccgggcaatcccggggtatgtcaggcatttcagattctgaccgcaaaggcgggaatctatggaatggtcggcggtcagacggtggacgtcgagtcggagggaaagccgggcatgaccaaggaaaagctcgattttatctaccgtctgaagacgagtgctctgatcgagggggcaatgctcacaggagcggtgttggcgggagccacgcagggcgaacagaagattatcgagcagacagccggtgaggtcggacttgcatttcagatccaggatgacattctcgatgtcacgagcaccatggaggtattgggaaagcccatcggcagcgatgagaagaaccacaagattacgtacgtgacctatgagggcattgagaaggcgaaggcggatgttgcgtcgctatctgagcaggcgattgcgcggatggattcccttgtggttaagaacgaatatctgacggaactgctcagatatctgatcctccgggagaagtaaactacgataaaaagcagaggtgctctgtatgatcttggaacgtatacaaaaagaaaatgatatcaaggaactctccgatgaggaactgaaaattcttgcatcggagattcgtcaatttttaatcgagaaaatctcggataccgggggacatcttgcgtctaatctgggcgtgatcgagctgaccatggcgctgcatctgtttttggatctgccgaaggataagctgatctgggatgtcgggcatcagtcttatacccacaagcttctgaccggaagaaaagagggatttgaccagctgcgcaagtacgggggaatgagcggattcccgaagcgcaaggaaagcgaatgtgactgctttgacacgggacacagttccacgtccatttcggcgggactggggtacgcgcatgcgagagagattaccggggagaattacaaggtggtgtcggtgatcggagacggtgcgctgaccggaggtatggcgtttgaggcgcttaataatgcggcacagcttaactccaactttatcattgtcctaaacgacaataatatgtccatctcggagaatgtcggcggattgtccacctacctggcggggttccgcacggcggatgcctaccgggatttaaagctcggggtcatgaattccctcaacaagattccggtctacggcgataagatggtggagcgtatccggcgcacgaagagcggaattaagcagctgttcattccggggatgctgtttgaggaactggggattatttatctcggaccggtggacggaggcgatatcaagggtattttaaagctgctgcaggaagcgtcgcgtgtggatggaccggtgctggtgcatgtcatcacgcacaagggaacaggctatgcacctgccgagcggcatccggcgcggttccacgggacagagccgtttgatattgagacaggacttcccaagcatccgcgggtaaaagcaaactataccgatgttttttccacggtgatgcgcaagcttggtgaccgtgatgagcgcgtggtggcaatcacggcggcgatgaccgacggaacgggattaaaacgtttccacaatatgtttccggagcgcttttttgatgtgggcattgcggagcagcatgcggtgacgttcgcggcggggctcgcggcgggaggcttaaagccgatctttgccgtgtattcatcttttttacagcgcgcctacgaccagatcctccacgacgtctgtattcagaacctgccggtggtatttgcgatcgaccgtgcaggacttgtgggcagcgacggggagacccaccagggaatttttgacatctcctatctctcaacgataccgaatatgaccattatggcgccgaagaataaatgggaactgtcggatatgattaaatatgcagttgatttttccgcgccgattgcgataagatatccgagaggagaggcgtatgacggattaagagagtaccgggcgccgatcgcctgcggcaagagtgagtggatctaccggtcggggaagatcgcgctgtttgcacttggtgcgatggtgaagacggcggaggcggtgcatgagcggctgaaggcgctcggctatgagagcagcttaatcaatgcgcggtttgcaaagccgctggatgaggatgcgctcctgtccgcagcaaggcatcacgaccttatcgttacgatggaggagaatgtgatcagcggcggcatgggcgaacaggtcatgcgtttttatgaggagcacaatctctctgtgagagtgcttgccatcgcgattccggatgagtacgtggaacatggcaatgtggagattctgcgcagggaagtcggaatcgatgcggagacgatcacggagcgcaccatagaggcatatgaagaactgcacgcacaggaaagcggtgcggaaaggaatgacttttgaaagaacgattagatgttttgcttgtaaacagaggactggctccgtcgagggagaaggcaaagaccatgattatggaaggcaatgtctttgtggagaaccagcgggaagataaggcgggggctacatttgacacggaggccgagatcaccgtaaaggggaatacgctcaaatacgtgagccgcggcggattaaagcttgaaaaagccatgacgcatttcggaatcacgctggagggtaaggtctgcatggatattggagcttccaccggtggatttaccgactgcatgctgcaaaacggagccgtcaaggtgtattccgtggacgtcggctatggtcagttcgcatggaagctgcgccaggatccgcgcgtggtctgcatggagaagaccaatatccgctatgtgaccccggcggatatcgatgacgtgctggattttgcgtcggtggatgtgtcgtttatttcccttaccaaggttttaatcccggcacgggagctcttaagagacggcggcgagatggtctgtctcatcaagccccagtttgaagccggacgggaaaaagtcgggaaaaagggtgttgtgcgtgacaaggctgttcatgaggaagtggtagagcggatcattgaattcgcgtcacagaacggattttttgtaaagaatctggaatattcgcccatcaagggaccggaaggaaacatcgagtatctggtgtacatccggaaggatgagacgggcggcgtggatgcggcagtcgacattaaggcggtcgtggatgcagcgcacggcgagttagacaagtaaccggacgtctgtgaatgaccgggtgtctgccggatgtggggaagcttatgagacattttttgatcatcacaaatacatataaggacgagaacggcagactcaccggagaacttgcggcgtatatccgcaaaaagggcggagaatgtgactgcttttacagtgacggggagagcaaaagcgaggcggcgcctgctttggataagatggatccagcgacggactgcgtcatggtgttaggcggcgacggaacgctgatccgcgcggcatccaggctagtggacagcaggattccgttgatcggcgtgaaccttggtacggtcggttatctgtgtgaactcgaggagagcaacgtgtttgacgcggttgaccgtctgatggcggatgactgtatggtggagaagcgcatgatgctcaccggcgcaggcatccttggcggagtgcgggaagaatacggggttgccctgaatgatatcgtgattcaccgcacgggggagttgtcggtagtcagcctgatcgtctatgtgaacggggagtatctgcatacgtttcgggcggacggaatcattgtgtcgacgccgaccggttctaccggctacaatatgtcggcaggcggaccgatcgtggatccgaaggcacagatgattttaattacgccgatcaatgcgcataatctcaattcacgcagtattgtgatcggtgcggaggacgaagtggttgttgagatcggcagaaggcgctcacagaaggatgagacgctggaggtcagctttgacggggataccgccgcaagacttgtggtgggagataagttcagtatccggaaggcttcggacacgacaaggatcttaaagctgagcaacaagagctttctcgagatcctaagcaaaaagatgcaggtatacacataagcgggaaacggagggcagaatgaaaaccaaacgacaggcgaaaatgctggaactgatcaagagaaatgacattgaaacacaggaagaactgtcggattatctggagcgtgagggctatcaggtaacacaggcgacggtttccagggacatccgggaactaaagctcaccaaggttgcaatgagcaacggcaggcagaaatacgttgcgctgcaggagacggacgaaaatctgtcgcagaaatatgtacgcgtgttccacgacggatttgtatccatggatatggcgcagaatattctggtcattaagactgtctcgggtatggcgatggcggtggcggctgcgttagatgccatgcatatgcacgagatcgtgggctgcattgcgggggatgacaccatcatgtgcgcgatccgcagtgtggatgataccgttgcggtgatgaatcgcttgaaaaagcttgtggaagactagacgggattcttttggggagagtagaaggagattctatgttacaaagtctgcatgtgaaaaatctggcgctgattgacgaggcggaggtggattttacccggggactcaatatcctctcgggagagaccggtgcgggtaagtccatcatcatcggttcgatcaatctggcgctgggtgaaaaagtgcaaaaggaaatgttgagagaagatccgcagaccggggagtttgctccggcgctggtagaactggtatttacggtggagaacgggcaggaacggcaaaagctggaggcgctcgaggtctatccggaagatgaccaggtgatcctaagccgcagaatcgtaggcggaaggggaacggcgcgcgtcaacggtcagagtatgccggcatccgcggtgcgcgagatcgcggcgattttaattgacattcacggtcagcatgagcatcagtcgcttctctcaaagcgcagacatttggagattctggatgcctatgtgggagagacgctgacagagaaaaagaaggcgctcgcagagacttaccgcagctacaaaaagctggtggaggaagagaaaaatgccggcatagacggcgcagagcgcgagcgggagatttcgttcctggagtacgagatccgtgagatcgaggaggcaggacttcgggaaggcgaggacgaggaactggagaatgagtaccgccggttttccaacggacagaagattgtgaatgccgtaaacggtgcatacagcaataccggcggcgaatcggactgtgcgtcggaactgaccggaagggcggtgcgcgaactctcgtcagtctccggatacgatgagaaacttgccgaactcgagcgtgagctgcttgagatcgacgggctgttaagcgatttcaaccgggaacttgccgattatgtcgagaatatggagtacgatgaggagacgttctaccaggtggagaagcgtctcgatgaggtaaatcatctgaaatccaaatacggcagcacgatcccggacgtgcttctggcattagaagagaagcaggaacgcctgatgcagcttaaggactatgacacgtatcttgccggtcttaaggaagagattgcgcggaccaaaaaagtcttagagaagcagagcagcgaggtgtccgcaatgcgtaaggaggcggcagagcggcttaccgcggcggtcacgcaggcgctactggatctgaatttccttgatgtgcgttttacgatgaattttgagcgcatggcagagtatacggcgaacggattcgacgatgcggaatttttgatttccacgaacccgggcgagccgttaaaaccgctcggaaaagtagcgtcgggaggagaactttcgcgtatcatgcttgccatcaagacggtgttagcggatgaggatgcggtggagacgctgattttcgatgagattgacagcggaatcagcggacggacggcgcagatggtttccgagaagatgaatgtgctgggacggtcacatcagattatctgtatcacacatcttccacagattgcggcgatggcggattcccattacctgatccagaaatccgtacagaatcagacgacagtctccacgatccgcagactgtcggaggaggagagcatacaggagctttcccgtatgcttggaggcgtggagatcacggagacggtaaaagagagtgcgagagagatgcgcgcgcttgcaaaaagcaaaaaaatcggggtttgaaaagtaaaaatattcacataataaaagaagataccacaggtatgagataccatggtatcttctttttttgttgtgtggcggcctttgggttacagaaaatggtatgggggcagatatgagacataaattttattttttgatacagcagatcacgtgggttgtttttttgtttttgacgctgtttgccgtaaagacgtttgagcgggcactgccggatgagatctacgttccgttcggggaaaaggcggattaccggtttggcgttccggtgagcgtgacgttaaaggacgacagcgaggaagtgttctaccgcttaaacgggcaggaggatgccatggcggaggcccctttttataccgttacctgcaagctgttcggcattttcccggtaaaagacgtgaaggtgatgatggtcgacagacaggaggtgactgcgggcggcgaggcgatcggtatctatgtgaagacggacggaatcctggtgctcggcactgcaaagattgcggatgcgtggggcaatgagtgcagcccggcgcagaatctggtgcagagcggggattatattgtgagcgtgaacggggagacggtgtgcgggaaagaggagctgatggacaagattgacagctacggcagcggacgtgagatcatcggagtgatgcggaagggggagtatgtggaagtatccatgaatccggtcaaaggcgagacgggaaaataccgccttggaatctgggtgcgggatgatcttgccggggtcggaacactgacctactacaggcaggacggcagctttggcgcactcggacatgcggtgagcgacggcgacaccggcgtgcagatgagcctgtcggaaggatatatttacgagacgaaaatcgtcagcatccagaaggggaagaacggcgtcccgggcgaacttgcggggatcattgactacgggaaatcgcattgcatgggaagcattacggagaactcgccgcttggcatccgcggcatgttaaatgatacggcgggagaactggaaggagaagtctacgaggtggcttataagcaggacattgcgcttggaaaagcctacatcatctcggaggtgtccggggagcgcgcggagtatgagatcgagatagagagtcttgattacagtggggatgaggaaaacaagggaatcctttttaaagtcacggatgagcggcttttaggcctgaccggaggaatcgtacaggggatgagcggcagtccgattatccagaacggaaagatgatcggggcggtgacgcatgtgtttgtgtcggatgcgtcgatgggttacggaatctttattgagaaaatgttgtgattgcacgacaaaaacttttacaacgtctggtacttatggtatactacagtcagtattgttggctttaaggacggaagacggaatggaacagcaggaacatatacaaaaactggcagatgaatactacgaagagggcagagccagattctttgaccacaagctggaggaagcggcgatgctcgtacagaatgcgcttcatctctacaagaagtgtgatgatatgctaaaatacgccacagcgctcaatatgctcggtgtgatctacggtgccacggggaacgagacgatggcggtggattatctggttgagggacttgagtgtgcgatagattaccagctaaataacatcacggcactcttttataacaatatcggttccaggtaccaggaactgggagaacatgagaaggcgatcgattatttcttaaagtcggcgcgggaactgcagaatccgacctgcataaaggaggagcgctaccgttcctggactctgattacctacctgaatctggcggtctcctactacgaactgaatctgtacgagctttcctacaaatatttagagcaggcagagcggcagcttgacgaggaagtggaggagatgtatcattatacggtactgatcttcaaatgtaggctgctctggcagatggaaaagggagactatgtgtatgagcacatggaggatcttctggcgagcggtgaaaaagacagcaatgcatcggattatctgagcgatatgaaggatctgtgtcagttgttccgcgacatgaaagagtatgaatactggaagcagaccatatctgcggtcgagacctatacgatcgatcagaataccgtctttttccggctttttctgacagaattgtggatggactactatcagactgtggggaacgaagagcgctatgtggaactgtgtgtggcacatgcggatctgtataagcgccagaaagcaatcgatgtgaaggatcgtgcaacagcgatcgacatcaaggtccagctgcgggaaaaagaggcggagcgtaagcgcgtggagaccatgtctgtgacggatgcgctgaccggactggggaaccgctattctcttgagcgtgaggcggtgcacatcataagggatgcgggcggtgagcggatcacggtcggcgttttggacatcgactgctttaagcagctgaacgatacctacggacatattcagggagaccgctgcctgaaggtggtggcggatattctgaaggaggcagtgatggactgcggacatgtctaccggtttggcggggatgagttcgtgatgttgtttccggcagggatggagaaccggatcgaggggatcgcggaggcgatcctgcagaagattgcggaggcgggaatcgcaaacgagcactcggttgtgcagccgaatcttaccatctcccaggggtatgcctgctttgtgccggagggcacagagagcggagcgcgtctgattgagcacgcggacaaggcgctttactatgtgaagagaaacagcagaaacgcatattatatcatacgcgaatgatgcatatacttcagttgacgactagcttcgacaaattttcttgcgttggaatcagtatcatcagtaagcaaagagttttgtcacaggaggggctaaaatggaaaaactgaatgttgcaatagcagatgataatgagagaatgctgcgattattaggggatattatcgaaagtgatgacgaactgaatgttgtaggagtcgcccgcgacggcgaggaagcataccatgtgataaaggcgaaagaaccggatgtcgtgctgctcgacattgtgatgccgaagcttgacggattgggggttttagaccgcgtgagtcaggacacctccataaaaaaacatccggcgtttattatgatcagcgcgatcggtcaggagaaaatcacggaagatgcgtttgcgcgcggcgcagattattacattatgaagccgtttgacaatgatatcgtgttaagccgcatcaagaatgtgagaagacctgcggcgggacgcggtgcggaagtgcgcaaggtcaatgcctatgagaaggcggaggagacaaaggagcgcaacctggaagcggatgtcaccgatattattcacgagatcggagttccggcgcatatcaaagggtatcagtatctgcgggatgcgattgtcatgtccgtcaatgacatggatatgctcaactcgatcacgaaaattctttatcccacgatcgcgaagaagtaccagacaacctccagccgtgtggagcgggcaatccggcatgcgatcgaggtggcgtggagcagaggcaagatggataccattgatgagatgttcgggtataccatccacaacggaaaaggaaaaccgacgaattcggagtttatcgcactgattaccgaccggatacgtctggaatataagatgcattaacgatgaggacatatttttcaggaggcgcaaagccgaagaagagtatgtcctcattttcggataaccggttccttttgagcgtcagatgtgctataattatacgatgatttttcggaggatggcagatgcagaaaaacaggtatcagctcaggtgcgcggcaggaaaatactggctgttagatatggagcaggatggagaaacgtatcggccgccgctcatgttaaatgagagcggggcttatatcttcaggcagtatatggcaggaaacacggcggataaaatcgcggaggagcttgccactatgtacggggggatcgcagacgatatgcggacagatgtgatgcagtttatcagacaaatggaactacaggggatcttgtaaacgatgaatatattattggtgggaagcaaatgccgcttccttcagcttttgacggacaaactggacaaagaagggcaccgtgtgtttttgctgacggcagaagacaaatcggtcagaacgtccaaaaagatatttgagacgtatcattttgcatacgacaatccgtgcatcagagaggtgcttgagggagtgcgtccggatgtgacagtctttatgggcgcctatgatacaggctttctctgggggaaggggagcagcacggcgtcggcgtacacttcaggcctgtttcagctgctgatgaatgagacggctggtaatgtgggacgctttttgtatctctcgtcggaggaagtcttcgggggagagtatacacaggacatttcgtgcgaggaaaactgtgcggcttatacggtacgcgcgcaggcgattgcggcgggagaggaactctgccgcagttactttaacatgggctatgagacgatcgtgctgcggctggatcatctctacggggaaccgcttaccggggcggaagcgcgtgatatctgcgcccgcatgagtgtggaggggctggaaaccggtgagatccgggtaaatccccacaaccgtgtggcgctgttacactattcggatgccgtcgaatttttgtatgcggtgattacggcaaaaaagatgacgtacggcgtctatcagatttcttccggagagacgatttccgttcgaagcgcagcggagtttgtggcggcggaactggaaggtgtgaaagtcgtagaggacaccggaagagagcggatggagccggttttgtccaaccagagatttgcggaggagtttgggatacgcattgtacataagccggagaccgagattggcagggaggcggcgtacatccggcagcacgcatcttcttttgtgcggacacagagcagaaaaaagggatggagccggttcggagagcggtcgagagaggccgtaagagcgatgattccgttcgcggagaatctgctttgtttccttccgtttttcctgttaaataactggatggcggggagcgcgtatttccagaacattgatttttaccttctgtatgtgctgctgttcgccattacctacgggcagcagcaggcgacattctcctcgattcttgcggtggcggggtatcttgcggtgcagatgtatcagcggagcggttttgatgtggtgctggatgtcaacacgtacatatggattgcacagttgctgattctgggacttgtgatcggctatatgcgcgaccggctgcatgcggtggaggaggaggagcgccatgaggtggatttcctctccagacaggtggaggacatctcggatgtcaacggcagcaacgtgcgcatcaaggagattctgtcaaatcagatcgtcaaccagaacgacagcttcggaaagctgtatgagatcacgtccagcctggacaagtacgagccgagcgaagtgctgttctatgccgcggaggtgctggcaaagctgatggacagtcaggatgtcgcaatctatacggtggcaaaccactcctatgcgcgtctgttctcggcaacttcgccgaaggcacgcatgctcggaaattccattcactatgtgcagatggaagaactctatgaaaagctgcgggagaaaaaagtgttcatcaacaaaaccatggatgagcgctatccgctgatggcggatgccatttattcggaggatgagatgcagctgattctgatggtgtggggaatcccatgggagagaatgacgctcggacaggcgaatatgctcactgtgatcggctatctgatccagaacgcggttgtacgtgcgaaccgttatctctcggcgttagaacagcaacgctatatccacggcaccagaattttggaggcggatgcgtttgcttctctggtgaaggcttatcttaacgcgagagagaagaaactgacggagtgcgcgcttgttgtctttgaggagggggagatctccagggaggaagccgcgggcgtgctttccggcatgatgcgccagagtgattaccttggagaactctccgacggaaagatgtacgcactgcttgctaacacgagcgcagaggatgcgggaatggttgtggagcgttttaggagcgcaggtttcccgtgcaggatgaaagaggagatggaactatgagcaggatcgaaacgtattttctgctgcttgtggtactgaatctgtgcgtcacggcggcgtatgtcctgtggaatgagcggcactggagagaagagcccggaaagcgcaccggcggaagaatccgcgcggcggttatgttttttgcgcctgtgatcggtcctgttttctttgtggcgggagagcttgcgcggcatcttttattcggacagtcggcggatctggaagatgttattttcagcaaggagcgtgtcagaacgcactttatggcggacgaggagcaggagcggaatgtggtgccgatcgaggaggcactggcgatttccgaccgggacagcctgcgcacgctgatcatgaacgtggtcaggggagacgtcacggactctctcggatcgctggcgctggcacttgacagtgaggatactgagacctcccactatgcggcgtcggtgcttcgggatgtgctcaatgatttcaggcagcatgcccaggagctttaccggcagatgcaaaaggacggcagggaggcgggggatgatgcctgccttctgatcgagtacatgtacgtcgtcttaaaacagaatgtttttcacgagaccgaacagcggacattcgtggatatgtttgaggaggcgtgtgaacttctttatgaaaaggattaccgaaagctcacggcgcaatacatcgaatggctgtgtgaactgctgctccgcttaaaggaattcgggcggatgcgctactggtgcaaccggagccgggaattatatccggatgcgctttccacgtacacctgctatttgaaaatgtattttacgcaggagaagaaaaccgaatttttccgggaactggatcggctgaaagcgtccaatatcgtcattgacagggagacgttagagctgatccggacgttcagttagtccggcaggaaggaaatgacatggtatcacgcagaaattatctgacgattgcaatgatgtttgtgattctgctttttatgtttcagtttacaggcgtcatgaaagaacagttaagtgaatatgagagcaacgaatatgcagacgataccacaacatcctttcaacggtcggatgcatttctggcggaacagacatctgccgacgcctgcgaggtgatctatgtgggcgaagcagggggagcggaggaatccgtggtaaagacatggtgcagctaccgcaagcggacgtttttttgcagcagctccctcgcactgcttgacagcctgcaggatgatgcactgcaggtgctggtggtggacggcagcaaggtgacgtcggaagaagaggtggcggttcttcgcagagaggcacaaatgggtgtgactgtgatttttgcaaccctgccgcagagctctgtgataagggagtaccgggatttaagagagcttctcggaatccgcgcggtgattgcggatgagataccgcttgcgggcatgcatctgttttccggctttctgctcggcggggaagagatctatgaggtcacggaactcggggaggaggagcgtcaggacatgaacccttctgttccctggtatacgaccggcgcgggaaccaagacctatatggtcggcacgctgtccgatgagacgatcgaacagacggtggataacgaaatacgggcacagtatgcgggaatggaggaagaggcggcaaaaaacagccttctgcctgccattctctggagaaacagcgtggatacggcaaagattttctgtgtgaacggggattatcttgcagacataagcgctgttggaatactggacgccatgatgggggagacatacgattacgatatctacccggtaatcaacgcacagaatcttgtgattgcagatctgccgacgttcgtctccgagaacgaggaggagatgcagaagcgctacagtcagtccgcacaggcagtgtatcaggaaattgtgtggccgtcgctgacctccattgcctcccggacgggggcaaagatgacctgcatgatgacgccgcagtttacgtatacggatgaggaagagccggatggagagaacgtcacctactatctgaaacgtctgaaggaggagcacgcggaggcgggactgtccgcagacagcatggaagggatcccgctctcagaaaaaataaagcaggatcagacgttctggcagacctatgcgccgtcctaccggtttttatccctctacgcggacggagtaaagagcatcggggagaagagtgcccttccagcggaaatccggacggttgcgctcggatccggcgccagcgggcaggcggtggggtatctcaatgagaacgtcacactgcagccgtcgacgagttccggaatccggcatacgtttctggatgattttaaagtgaaatgcatggagacggcgctcggctattccaacatcacactcgacttctatagcgtgacttatccggaaggggacgaggattcctgggagaaaatgtccaagaagatcgcagcaaacctgggcacctactggaaagcgtatgaagcgtttgacgcaaccaccctgacagagagtgatgtgcgcatccgcagatttctggcacttgactataagcagcagcgcgcgggcaatgtgattacgctttccttagagcaccgggaggatgcggcatggtttctgctgcgcctgcacggagagaaagtcacagaagttgcgggcggaatctttgaagagatagaagacggcgtctacctgattcttgcagaggaagatgaggtctccgtggaagtgcagaccggggaaacatggcagtatcaggacggcggaaagcgtggtgacggcacatgagaatatgtattgtggcagagggatgctatccctatgttgtcgggggtgtatcgagctggatacacagtatgataaaaatatttccggagtaccagtttgtcgtgctggcgattgtggcgaaccgttcgctgcgcggaaagtttgtctacgatctcccggagaatgtggtggaagtgcacgaactgtatctggaggatgcagactggcggccaaaagaacttaaaagagcagccagactgaagttaaatgagcgggagtacgccgcactgcggagcctgttgatgaaccagaatgtagactgggataccctgttctcctttttcggggagaaggaattctctttgaatgaacttctcatgggggaggattttttccgggcggtgcaggaatgttatacggtgcggtatgcgggggcggtgttttctgatttcctctggacgatgcgctccatgtatcttccgctgtttctgacacttggcatgcggctgccgagggcggatgtgtatcactgtgtggcgacgggatatgcgggcgtgctgggcagcatggcaaagcgcaggtttggctgcaggcttctgatctcggagcatggaatctacaccagggagcgcgaggaagaactgatccgtgcggactgggtgtccggcatctataaaaatatctggattgagcagttcaagaaaatgtcgaagcttgcctatgacagggcggatctggtgacaagcctttacgcgcacgcgagagagcttcagatcgaactgggatgtcctgcggataagacgagcattaccccgaatgggattgatccggcgcggtttaccggcttgaagcgtccggaagcgatggagccggatatggtgcacatcggtgcggtactccgcgtgacgccgatcaaggatgtcaagaccatgatccgggcgtttgcgtatgcaaagcgcgatgtgcctaacttaaaattatggatcatggggccgacggaagaagacgaggaatacgcgagagaatgttttgatctggtggagctgatggaactgccggatgtggtgtttaccggaagggtgaatgtgacggaatatctcggcggactggattttaccattctgaccagtatcagcgaggggcagccgttaacggttctggagggctatgcggcgaagcttcctgcgatagcaaccgatgtcggaaactgccgcggactgttgtacggcgaggacgatgattttggcgaggcgggaattctgacgcacatcatgaacgtgaaggagatcgcggatgccatggtgaatcttgccagacatccggtccgcagaaaacagatgggagaaaacggttaccgccgtgtgatggcaaagtacaagatttcggatatgcagcagacgtaccggaagatttatgaaacgtttgagaacatagactggtagaagggagagagactgtggcaggaataggaatcaagctccagaaaatatatgagaaaaaaacgattcttgcatatctgaccggattcggctacagtgcggtcgtgacggtcgcaccgatgtttgtcgtgatcggaacggtcatgctcatgagtcagctcctgggatatgagaatgtgggatatgcgaggagaggactgttttccggaacgctgctttacatctttatcttttcgcttctgacggcggcgccttttaatgcggtgttgtcccgctatatgtcggatgtcatctatgaggagcgctatgaggatattctgccctgttacgatgtggggctgcttttaaacattctgctggcaagtcttctcggaattccgttttgcgcatgggaacatcttgtggaacatgtcaatctgatttttgtgtttaccggattttgcggttatatcgcactggttctcgtgttctactcgatgctttacctttccatctgtaaggattatcagaagatatcgctgtactttttgaccgggatggcggcggcactcgcctgcgccctcttttttgtaaaagtatgcggcagggagattgtctacagtatgctgctttccctcacgatcggattctttcttacggcggtgttggaatatgccacggtgaagcgctattttaagaggaacagcaaccggtacagaagagttttttcgtattttggcaggtactggaagctggtggtgatcaattttttgtataccctcggtctgtatattcacaattttgtgttctggaatacggatttacagatgcgcgtggcggatacgtttgtctttgctccgacgtatgatctggcgacctgtctggcgatgtttacgaatctgtcgtcgaccatcatttttatcacgcgggtagagatgcatttccacacacgttacaaggcgtattcggaagcggtcatcggaggaagatgggaagatatcaaaaatacaaaagacagaatgttccggcagctttctgcagagcttatgaatctggtgcgcatacagtttatcatctcgacggcagtgtatctgctctgcgtggtggtgcttccgcagtacgggttctcgggaagagtgatgcagatctatccttgtcttgccgccggatattttatattatttattctgtatgcagaaattatttttctgtactactttaacgatctgacaggggcgcttttggcaaccctcggcttttgtctggtgacgtgggcgggaagcgtgctttctgccggcgggagtgacctgtggtacggcatggggctggtggcgggcagctttaccggctttaccattgcctatttcagactcaggttcatggagcgccatatggatgaacatatcttctgcggcggacagctgtttacggtgaagagagagcggatgccggagagtatggtatatacaaagaaacagaaggagcgttagtatatgaatgtgattttaattctgcggatttttctgacggcagcgggagtgttgttccttttgggggacatcaatgcgtatgtgagacaaaaactgaccgatacgattggacttctgtgggcatttgtctcggtggcgctgattttaacgggcgtggtctccgtgccgggggcaagggaggaggaatacctggtggtgcttcttctggcagtctgcctgctgcttttgatcctgctgtttaagttaagcaaggtggtgtcggttctttccatgaaaaatcaggagcttgccatgcaggtttccctgctcaatcaggaaaatgagagaatattgcacaggctggggattttgacagatgaaaaaaaagatattgttcgtgattaatacattaagccgcgccggagcggagacggcactgttggaactgcttgcgcagcttgctgccgagaggggggaggacgggcagcccagatatgagctctcgctctttgtcctgatgaaccagggagaactggtgcagcagataccagagggggtgcggcttgtcaatccaaggtatgccccggtctcggtgctcgaaccaaagggaagaatctatatgggcatgaccgttgtaaaatgtctgcttcacagagccaacctgatccggctgtggcgctatcactggagggtcgcgcgggcaatgcgcaaagagggacggctgatgccggacaagctgctgtggcgggcaatctcggatggcgctagacgcttcccggaggaatatgatcttgcagttgcattcctggagggcggttctgcatactatgtggcagaccacgtcaggacgaaaaaaaaggcggcgtttattcatatcgactatcagaaggcgggatacagcagggaactggaccgcgactgctacctgcaatatgatgccgtatttccgatcggggaacaggtaaagcgggcgtttctcgccgtgtatccggagtgcagtgcacgcaccaggatctatcacaatcggatcgactgtgaaaaaatccggaagatgtccgggcagccgggaggatttacggatgatttcgacggaatccgcctgcttacggtgggaagactcaccccgcagaaggcatatccggttgcgatcgaagcgatgcggcagttaaaggcggagggatacccagtccggtggtatgtgctgggcgagggaagcagccgcagggaattagagcagcacattgcgtcgtgcggattaaaggaggatttcctgctgcttggagcggttgagaatccctatccgtactaccggcagacggatatctatgtgcatgcgaccggatatgaggggaaaagcattgcgatacaggaggcgcagacgcttggctgtgcgatcgttgcttccgaatgtaacagagagcagattacagacggggaggacgggattttgtgcgcgcttgacgctgcggcggtaaaggaagctgtgggcttcctgatccggaatccggaccggcgcagggcgtacgcgcaggcggcgttaaagcgtcctgtaaattacgagaacgaggaacggctgttggagcagctgctttccgagaaagaataaggaagatacgatggtagagaagaaacaaaaagaactgctgattatcattccggcatacaatgaggagaaaaatatagagcgggtgctggaggagctggaacgcccggagatcgcggagattgcggatattctggtcatgaatgacgcgtcctcggactctacgaactgggtcgtaaaggcacacggacatacgctggtatcccatgtctttaatctggggtacgggagcgccctgcagcttggatataaatacgcgatccgccgcaaatattcctatgtgatccagatggatgcggacggacagcatgatgtgtgcaacataccggtgatctatcagagactaaaacagcaggatgcggacggacgctgcccggatatcgtgctttgttcgcgttttatggagggaagtgcagagtattcggtctccgctacgaagaaactggcatacggattcttccgctggatgataaagatcagtaccggacgaaagattgccgatccgacgaccggtctgcagggacttaaccgcagggcatttttatattactcgaagtataagcactttgacgacaagtatccggatgccaatatgatcattcagatgcagctgctcggattccgcatagatgagatccctgctgtcatgcatgcgagaagctgtggcaccagcatgcactccggactcaaaccggtggtctatatgttccgcatggtcttctccatcatcggcgtggtatttcggatcaaggtgcttggaattgatgcgggggcaggagagcgggatgttttcatggacaaaaaggagtaagcgttctttttacgcagaaaatttaaaaagacagcagaagccctatattgctccggggcgtgggtggtatcacatctacacgttccggctggggagaccggagaaagtatccttagactggctgccggattatcccggggagacacttgctctggtccggctggacatccgcgattacgcctcgcgtgaactggacactcttgcactggactttgcggagcagatttttcgtgcctttcaagagcggaaaaaagagatgatcctgcgcgtctgttacgatacggagggaaaggggatggagcgcgagccgcagcgcatttttgtggtgcagagacacatgcaggcgctcggtagttttgcggaacggtatgcggatgccattctgaccgtgcagggcgtgtttgtgggaagctggggagagatgcatacctcccggtttctgcgcccggatcagatctgcctgctggcgcagacctggcaggaggcgacgcaccatgcgctgacactctcggtgcgaaagccggtgcatctgcgcatgctggcgggaaataggccggtgcgcggactgggactatacgatgatgccatgtttgccggagccgaccatatggggacgttcggggatgtgccgagggaggcggcagactgggaagaaccgtggtgtgcggcagatgagcaggcttatctgagcggacaggatgaaaatattctgtgcggaggggaggcgctggcgggaataaagctgtccgcggaggcagtcttagaggaacttcaaaagatgcaggtgacctatttaaacagcatctatgacccggcgcggatggcagagtggaaggcatgccgtctcccgtccggaaaatcgctgtatgaggagatcggcagccgcctcggttaccggatctgcgtgctttgtgcagagtggaaaaagggaagcctttgggtgacactgaaaaatgaaggattttccgccgtatgccagaaaacggatctgcttctgatccgggagtgtgatgaaggcaaagagcagaaggtgcagaaggttccttatgagatctgcggattaaagggcggtcagacggacgtggcaaaggttgaaattgcggcgggagaagacgacggggaaggaaaagaggagaaactctacctttccatggtgcggaagaaagacggaaaaccgctgccgtttgcgaatgaaggcgcgggaagccggctcttgatcggcagatggatggtgcagggaggattgcatggaagagaaaaaggaaacacagattgattttgtgattgcctgggttgacggcggggatccggcatggcagagagagcgggatcgatatgggaagatgggggagaaaacagcggtagaagagaccggagagagagagaagtccggcgttgcctgcgataccagggatgtgcgctaccgtgattgggactgcctgcggttctggttccgcagtgtggaacagaatgccccgtgggtgcacaagatctattttgtcacatggggacatgtgccgaagtggctgaatgggaatcatccgaagcttgagattgtgcgccacgaggattatattccgggagaatttctgccgacgtttaattcccacacaatcgagctcaattttcaccgcatccccggattgtcggaacagtttgtctattttaacgacgatatgtttctgttgcggcaggtaagccccggacagtttttccgggacggaaagccgcttgacatgcttgccttacagccggtcgtggcaaaccgggaggatgccgtcatgccgtatatctatctgaacaatgcgatggtgcttgcgaggtattttgacaagcgggaaaacatgaagcagcagccgggagcctactggcatccggggtatccgctcttatatttcgggtataacctgctcgagcgcatgttcccgcggtttaccggattttatacggtgcacggtccgtcgccgcttctaaagaacacctacgaggcgctctggcagcgggagggagcgcttttgtcggaggtgtgcagccacagattccgcagcagggaggatgtgagtcagtatctgctcagagaatggcagaagctggagggtaatttttatcctgtcaatgcctgccggttctgcaggtattatgatctctcggatcagaatacatcgctgcttcatgtgattgagaagaaaaaaagcccggctgtctgcatcaatgattcccagaaggtggaggcgtatgacagggtcaagagggaattaaacgaagcatttttaaaagcttttccgaaaaagagttcctttgaaacggacggagcaggggaaaagcactaagacagagaggagacgccatggaaacaaagagcagaacagaatattcggcaatgaatacaaccgtggcggtcatctccagaatgacggcgattctgatgggatttgtgacgcgtgtgatttttacgcatacgctgagtgaaaactatgtcggaatcaacggtctgttcaccgatattttaaacgtgctttcgttgaccgagcttggcgcaggcacggcaatcacttacgccttgtaccggccgatcgcggagggcaacatcaagaagcagcagcagctgatgaagctttaccagacattttaccgtggaaccgcggtgtgtgtgggcgtgctgggactggcgctgattccgtttatggacgtgctcatgaaaaacagacccgaggtggagcatctgacgtttatttaccttctctatctcgccaactctgtgctgtcgtatctgctggtgtacaagaggacgctgattgaggcgcatcagatgaattatgtggtgctcatctatcagaccggctttttggtgctgcaggatctgctgcagattgttgtgctgcttactacgggaaactttattctgtttttgttgatgtatctgatgtgcacggttctgtcaaatgtgtgtatctcgcgaaaggcggaaaagcttttcccgtatttaaaggaaaaagagaaggaacgtcttccagcagaggagcggacgggactgtttcggaatatccgcgccatgatgatgcacaagcttgggacggtcgttgtaaataataccgataatttactgatctccgcgtttgtcggcgtggtcagtgtcggaatatattccaattattatcttctgatcggttccgtccgccaggtgttggaccaggtctttgcgggaattacagcgagtgtgggcaatctgggagcaacggaggaccagggcaaaatccgcgagatttttgagacggccttttttatcgggcagtggctttacgggtttgcggcgatctgcctgtacgaattgctcaatccgtttgtggagctggcttttggcagacagtatctgtttgaacgctccgttgtcatgatcttatgcctcaacttttttatcaacggaaccaggaaagcggtgctgacctttcgggattccatgggattgttctggttcgatcgctacaaggcgctggcggaggcggcgctcaatctggtgctgtcgattcttctggtaagacagtatcagacgctcggcgtatttatcggaacgtttttgtcaacgattctcacgtcggtgtgggtggagccgtttgtcctgtaccgaagaagattgcacctgccggtgcaccggttttatttgcgctaccttttatacgcggtctgtgtgggagcggtatggattgtgacagacctggtctgcggactggcagagggaagtccgcttaccgttcttctcatccggctgccgctctgcgtggtgctgcccaatctgttgttttttatggcatacggcaggacgaaagaatggaaacgggtgttggagcgcctgcggcgcatcgagtggggcaggctgcatcggggaggaatgtgatgagacagcagatggaagaagaacaatgggatttgtgcaggctgctggatgcggcgctgcacggcagaccggcggaaatgctcccgccggctgaaaaatacggagccattcttgaactggcagaccggcatcgcgtgctgccgctgctgtacgacgtgctggcacccaagctgcccgaggaggatgagaaccggaagcgccttgagaagagaagcgcagagacggtgcggcagagctaccgcttgctgttcctcgggaaatatgtgacaggacttttgcgggaacatggaatcgagacggttcttttaaaggggagcggcacggcgggactctatccggtgccggaacttcgcaagtccggggatattgatctgctcgttgcggatcagaaagcgggagaaaaggcgtatgaggtgctgcatgagcatggattccggaaagccccagagcagcacgcgcaccatcatatcgtctgcgttggcacagagcagatcggaatagaaattcacgttgcgctggcagagccgttcgactccaaaagcgtcaacgagtggctcgccgcacatcaggcggaatttctggcgcactgtgagaggacggcggtgatgggcgtagagtttccggtgctgcagccggcatatcatgcgttttacctgctgcttcatatgctgcagcatttcctgcgtgccggattcgggttaaagctgctctgcgactgggtcgtattctgggaaaagggatacggcagcggggtagaggagcgttttttctccatggcagaggaatgccgcgtgatgggatttgcgcggctggtgacggcggtctgtgtaaaatatctgggactttccggggaaaaagtgcccctgctgctttgcagatttgactgggaggcggaagctgcaaatctggaagcattcctgacagagattctggaagcggaggagttcggcaagtcaagtgccgaccgtatggtggcgctgcggggaaccggctggcgggattattgccgggaatttcatcatcagatgttgctcacctatccaggggcagggcgctaccgcattctgcatccggtgttgtgggtgatgatgttctgcggttttgcataccgcaacgttaagatgcgccgggtatcggggtacgcggtgttaaagaaggcgagagcgcgcggaaagcttgtggaggagatgaagctgttccgctagaaaataggatgttcgacgggaaaggaggagagcaaaatggatacatggtactgggcactggaatatgtcagggtattttttgcctatgtgatgattctgtttgtgtggccgtctgtggtattccgggattatttaagaggcaggagccgtacggtgcggtttgctttctgtgtgacggttccggttgtgctgctcaatacggtggtactaagtctgggcgtgtttcatatactgtacggatggctgattgccgtgctgttttacggcacattgctgcttggcttgctgagatggcaccccgtgcggcgggagcagatcaaaaagatctcccgcctgtttctgggaacctacggcatccggcttttgctgcttcgcctgcgcaacagggtaaaaaacgggattgggcgtgcacatgcacaattcaggcggagcatacggggacggcgctgcgtctatctgatgctgggggtggttgtgtgctttggcatggtgtatttttcctacggggcattccatgattactcctacgggtttggcgatatgtaccgccaccactcgtggatctacgggctgttaaacggtacgcctttttatgagggaatctacccggaagccatgcactgctttatctacgccatgcgcgtgctgttcggggtaaagatttatagcagccagctgtttctggcgggaatccacgtcgcggtttttctggtcagcgcgtatctgctgctgaaggaattatttgcatgggatggaaccgcggtgcttgcactggcgttgttcctgaccgtggatcttttgtgcattgacgagatcttttccatgtcccgtctgcagtggacgctgccgcaggagttcggactgtatacacaattcctgtgcgcactgtttctgcttcgctgccttaagacggactttagcgacagatccggcagccggagagagcggatcagaaagtttttgacggatgagaatctgctgctgtttctgctgtcactggcggcttcccttgccattcatttttatgtcacgatgatggcgtttttcctctgcgtggtgattgccgcgtgcaggcttcccgctctttttcaaaagagaaggtttgtatctctcgtaaaggcggtctgcctcggtgtgctgatagcggtgctgccgatgggaattgcgtatgcgaagggtgtaccgttccagggatcgatcggatgggcggtcaatgtcataaacggtacggataccgcggaggggcgtaccagccaggcggaacagatcttagaacaggcgcagacatcgagtgagcagacatcgaaggagcagacatggtccggtgagaggatgacagagagcggggagacgacagaagcagcggtgcagccgacggaacaatcccacggggggaacgggcagacaccggatggcgggagtgcggatgcgggacaaaatagcgctccgaaacaatctgccggtaatcatatgcttgcgatggcagaacggatggcggcatcgttcgccggcaaggcacaactggtctggaaatacgggtatgtgcagctgtaccgtgagaaccgggcggaatggattgtgctttttagcggtctggcactgatcctctgggcggtgtaccggatggcggcggggattatcaccggcctgctaaaaaagggaagtgacagcaaaaagatccggcagctgtttgacggatatccggtgctggtcggaatatcggtattgcttatgattgtctatgcggcgccgttcctcgggctgccggagcttattgcaggctccaggctatgctctacggaacagcttttcattctggcggtcgtggtcattccggtggatctggctgccggggcaatcgcccttacgcccggcagacgtgtgctgccgcttgcgcttgccgcgggagtggcggtgatctatgtggggacgagacagcgtggcatttttcacggatacctctactatgaactgaccagatacaatgcggcggtgatggtgacacaggacatcacggataaattcccggagaacagctatacgattgtgtctaccacggacgaactttaccaggtgatcgaacaggggcggcatgaggagcttttgactttcctgaaccgggtgaacggaagtggctataccctgccgacggaatacatttttgtgtatgtggagaagcggccgatccaatacgcgcagaaccacttctttaccggaccggactggctggcagaggaaaaatacacttcttactatacgacctatttcagcgaggggaacagcatcaatgcctcggagatctcgcgggagcaggcagagagggagatgatgacattctcaaaactctcgcagacctattccaatctggacagccgcacgatactggaatccaaagcgtacgaatggtgcaggaagtttgaagcatcctatccgcaggagatgaaggtatattatgaagatgagaatttctgctgctatatgatacggcagaacacctatcggttatatcagctggaggaatcatgagtggacgttggaaaaggattttggcgcttggcgcagcggttgttttgtgtcttatagcagcagctcaaatgggcagtctgtttcactggaaggtgacatgtacgccggcggcgtttgcagagtcatccaggaggctttccaatccggaccgcggattttattacatttacggctaccgcattacggatgaaccggtcgactatgccacagatttaagagacaggacgagggaagatgacgcgacgcggcttggaatgatgcagatcaatctgcgggaataccggacgggtgccatatcggaggaggggctgtcaaatgtccggcagttgtttgcagccatggcggacagcgacaagaaatggatcgtccgtttcctctatgactggaacggggagaacgagcagtatgaaccggagaatcttgacattatattgcagcatatggagcaggtgggagatgtgctccgggagtatcacagctgtatctatacgcttcagggactctttatcggcaactggggggagatgaacggaacaaaatacacggatccggattctatgagagaactggcggcacgccttgccgatgtgagcgatgcgtccacgtttctctccgtgcggacgccggcgcagtggagaaaaatcacgggggaggcggcaccggacggctggacagagaacccgctggccaaaaggcttggactttttaatgacggcatgctgggaagcgtgagcgattacggaacttacagcgataacaccagacaggacgccggggatttttcggcgtggacgcgggaggaagaactggcatttcaggatgtattgtgcagcagtgtgccgtccggcggggaagtgattgtcgataacccgtacaatgatcttgaaaatgcgatcgcggatctgaaaaccatgcatgtgagttacttaaacgaggactatgacaggaatgtcctggataagtgggcagggacggtcgtgaatacagatgactgctacgacggaatggacggctggtcttatgtggaacggcatctggggtaccgcctgtggattgccggtgccgctttgagccattcgttctgggcggatacggtggaggtaaatgctgctttaaaaaacagcgggtttgcaccgttttaccggcagacaaaagtctgtgtgagcgttacagatgagacgggggcagtctgctatacggatgaatgggaagaggagctacttaagctttccggcggaaatgaggacgacagggaactggcgctcaccggaaccattccgatccgcggctgggagagcgggacttaccgggtatatatcaatcttagcgatgcagacagcggggaacagattttacttgcaaacgaagcggatgccacagaaaacggatactgcctcggtgaggtggcagtgcgataggtgcacaacgatgcaagtacaaaggcttacaagtgcaaaatcgtacaagaaatcacaagtttgtacgaggaatcacgccgcagaaaccactataatgaaaagaaaaagaatcctgtatgtggtgggattgtggaaggtggtttcttatgcagaactatgaaaaaccggaagtgattttgatgacggaatgttcggagggcgtctatctggcaagcggcggacagaccggggaagatccgacggcaggtggatgtgacagccggtacatgaagggagcctggaaaaagccggattacagcaacagcaatgtgcagatgcgtgcctatgacagaaaaggctgcgagggctgtgcggcggatgacggtgacggctgcaagctgcaaaagggtgatgcaaaagtcgccggaaatgtctatcagcctgtctgggaacagcagggactgacaccggatgccatggtctggtagagaaaatgccggcatgccgttctggcagaaaattcatgcttgacagcgtaaacacagaattttatacttaaaatatgtgtatgagtcagcggcagaagtgccgcaaaaaagtgttagaaggtggctggttttatgaagaattatgagcgtccggtgatgatacggacggaggagcttgcagagggggtttatcttgcaagcggaggcatcaagtgtgacagtgtctacatgaacggtgtgtggcaggcgccggattattccgactggaatggcaccacacgcggatacaagcagcagttcggatgtcttggatgcccggcgaatactgcttccggctgcggtctgttgagccattatgtggattccgggtatgcgggaagttacgatgtggataatggtaaccgtaagccgtcatgggagaagaagggctatggtccggatgatgcggtcacagactggaacatgtaacaatctttaaaacgggggaaatgctatgacgaattatgagagtcctgtgattcttagaacagaagagcttgcggaaggggtctatcttgcaagcggatgctatacggcgagtgcgtacattcatcagacaccgcagtccggaagcggggagtaccgtatccaggtgaacggtcagcacagtgccgatcatacgaaagaggcgcagacactgaccatttcgttcagtcttccggtaacctacaccagttccggcggatcactggtatccggcagcggaacgaatacacttgtgatcaattataactatcatcagaatccgaccgacaatatcggactcggggatctggttgtgcaggcagatgcggggcttgcggtgacaagcgtgaacattacagattaagaagccggcaggcgaccgggcggatgtgagaagtcaaaagcttcgcgggaggaatcggttcctcctgtgaagctcttttttatgtaataggaaacttctttcctattacataaaaaactctccagggatcgcactgcggcggagacgaaagatgtcgcaagagcgacccgccgcaggcggagaatcctgcagacagaattcatttttatgaaagaataggaaaattacaatgcttgagaagttcagacattacagagagcggatcaaagagggaatgctccgtgatatgtggagacagacgctatggatctacgaatatgcgagactttattggaagcagatgatattttatacgcttctgggacttgcgggaacgctggtatcgctcatttcaagtctcatttcccgcgatatggtggatattatcacaggacagcaggcggggcttctggcgcgcaccttctgcctctatatcgggttctcggttggaaatgtcctgatttcccagatctccaattactttgcgaacaagatcagcatcagcgtggacaatgccatcaaggcggatatttttgaaaaaatgctgttgacggatctggagtcaatccagaactaccacacgggagatcttttaacgcgctggagttcggatgcctccaatatttcaagcggtgtcctaaactggattccgaatctcgtgatctatacggtgcgttttgtcagcacctttgcggtcgtgttctaccatgatccgatgttcgcgttattagcgctgatcggaatgccggtcagcatgctgatgtcgaagacgctgcttcgccgcatgaaggggaataatgagcggagtgcggcgatgagcgcaaagatgtcgggctttaatcaggaggcgttttccaatatccagacgatcaaggcatttgatctgatccggctgtacgcggagcgtctgcgcggtctgcagcgggagtatctcaccatgaagctggagtttcagaaaatgtctatggcgacctcaattctgctgtcgatcgtgggacttgcggtgtcttacagctgctacgggtttggaatctaccgtgtgtggagcggtgcgatctcctacggtaccatgaccatgtttttatcgctgtcgggctctctcacgggaaccttaaaccagctggtgtctctggtgcccacggcagtgtctttaaccacatcggcgggaagactgatggacattctcgatatgcccaaggaagatttttcggatgccgatcaggtggagcagttcgccggacagaatcggtcggatggcatcggaatcgtcttttccggggtgagttacgcctatcataatggaaagcaggtgttttgcggtgcagactttttggcgcgtcccaaggagattgtcgctctcgtgggaccttccggggaggggaagacgacaatgctccgcctgatgctggggcttttgcatccgcaggagggagagcggatcctgatcggggagacggacggggagaagatcgccgtagatccctctgcaagacggctgttttcctatgtgccgcaggggaataccatgttttcgggaacaatcgcggaaaatatgagaaatgtaagaccggaagcctcggatgaggaaatctgtgaagtgttaaaggcggcatgtgcctgggagtttgtggaaaaacttcccgatgggatctattccatggttggagagcgtggaggcggattctcggagggacaggcgcagcgtctgtcgattgccagagcactgcttcgccgatcaccgattcttctgctggatgaggcgacctcggcgttagacgtcgtaacggagcgcagagtgctgcggaatatcatgagcaccacggagccacgcacctgtatcgtcacaacacaccgcccgacggtattgtccatctgtcagaaggtgtaccgcatccgggagcagaagtgtgtgcagatgcaggaggaagagatccgtcagatgatgcgggaattctaaagagcatcgatggcggcttttaaggtcctggcagcggaaggctctttcgtgcagtacagccggcaggaaaagatgagcggagcgagggcttcggaaaaatgcagattgcgaaggagaagctcctttgtccacgcgggggagatcatccgctgcaggatgtggagcactttttcgtccggctgcagggactgcacctgatctatggcagcctgctttaagaagatgatgccgccgagcggatagtctttcggggtgcagatgcccgatgtgccgcaccatggaagtccataggcgtagggtatgttgtctctgattccgagcaggtttaagtcgccgtttaagaggggcgtctggtacagatcatgccacagggcagagtgtgtggacttcccggttccggaactgccggaaacgagaaaggcgcgcccgcggtacaaaaaagaggcggagtgcagcacataaagctccttctgctgagccaggatgagaaaagcgaagcgaagtgcgtgaaacaggtcttcgatgtgcatatcatccggatccggcatgcggtaaaggacggcgcgcgagccgtctttttttacatgcatttcgcggatgccccacggcgctgcaaaaaagaaacaatacgaacttccgctgtcgcagatggtaagttcctccgtgtgaataagcacggcgccgtaaggaatggaagccggtttcccggtcagaataagaacctcctggtcgaagtcttcctcttcgcaggaaaaagcggagaagaagcggtcgtataggagagagggaccgcggtaggaaaagaccagaggaccgatgcggtagaaaagaggaggcgtatcatcgccccggctttcgggtgtatccgcaagaagaattcccatacggcacagggaatgaagatactggtcgacatcttccgcaagtgccgcgcgctcgcgctctgtggcatggtaacggtctgcgagaagggcgagcagttcctcgcggctatcgccctctaagatgccgtcccacagaagtgccccggaatcgttgagccgggtggcaggagcgggagctgcgatgagctgtccgtaaggaagcagatagggaatacctgcgagcgttgccttgatgtatcgatcgttgagtttcataccggtgtcactcctttattagcggttcataagtatgcttattatagcattcagaggtaaaaaatgctacaatgaatgaagagaaacgggaggggaagaatggagcagatctatgagattgagccgctccttaaggcgggagtatgcatacagattcatccacaggggtacagcatgtatccgtttatagatccgcggagggacgaggtggtacttgccggcatagaggatgggagcgcgctgcggcgcggggacgttgtgctttatcgcagggaaaacggaatgctggtactgcaccggatttataagatcgggcaggacggactgtatctgctgggggatcaccagacagccatcgagggacccgtgcggcgggagcaggtcaaggggaaaatgaccggtatggtaagagacggacgctatatggatgtggggaatccgggataccggatgttaagtgtggtgtggctatggctcagaccggcgcgcagagctattatggtgcctgccgcgcggctgcggcgcatggtaagattcgcacttttcagaagaaacaataagcgctataataaatagagggatcaaaaagcctgggggtgattacatgatgaagattttatttgcagcttcggaagcagtgccgtttatgaaaacgggtggtctggcggatgtgaccggatcgctgccggggtatttcgataagaagcattttgatgtgcgcattatcatgccaaagtatttatgcatggatgaaaagtggaaggcacagctgcggtttgtctgccatttctatgtgaatctcagctggcggagacagtacgtcggtatctttgaaacggtacagaacggcattacatactattttgtggacaatgaattctactttgcgggagataagccgtatcacaatatctatgaggacgtggagaagttcgcattcttctcgaaagcggtgttagaggcgctgccgtatctggatttctggccggatgtcattcactgccatgactggcagacgggactggtaccggtattcttgcggacattttacggggatcagagatgttattccaatatccgcacggtcttttccgttcacaatctgaagtttcagggaaggttctcactgccggcggttatagatattaccggtctgccagagcagatcttttcttcggataagctggagtcctacggggaggccaactacctgaagggcggtgtggtgtatgccgatgcggtcacgacggtgagccccacatatgcgagagagatcatgacgccggagggcggagagggattggacggtctgatgcgcgcccgggaaggcagcctgtatggaatcttaaacggcattgatatcagggaatatgatccgcagacagatgcctatctggcgaaccattacaacgagaccaatcacacggaggggaagggactcaataagttaaagcttcagaagcttttgggactcccggtggataaggacgtatttttacttggaatggtgtcccggatgacggatcagaagggatttgacctgattgcctatgtgatggatgaactgatgagcaccgagcgtctgcagcttgtggtggcgggtaccggtgaggcgcgctacgaggagatgctgcgctattttgcggaaaaatatccgcagaagattcacgtgacgatcggctactcggaggagcttgcacaccgcatctacggctcctgcgatgcgtttttaatgccgtcgctgtttgagccgtgtggtctgtcgcagctgatgagtcttcgctacggaaccgtgccgatcgtgcgcgagacgggcgggctgaaagatacggtgatgccgtacaatgaatacgagcagaccggcacaggattctcctttgccaattataatgcgcatgaaatgctgggcgtcctccgctatgcgatgcgcgtgtattacacgcagagaaaatgctggaacggcattgcggagcgtgcgatgcgggaggatttctcctggaaaaagtcagcggagatgtatgcgcggctgtatgaggatatcgtgggcagaccataggatcacatagtgatctggtccgtctcgagggagtagtagtagacgtgatccgacaaaatctcttctctggccagctgggacgaattgacgtcccggaccatggaggagagtgtggacatactgatctggttgtctgcgggaatcagaagaacttcgtggacgctgctcggcagaatataaaaatcactgccgatgcgccgggcaaaatcgtgcagcagatgctgatagagaatacaggaggagccgttgagcctgtgctggttggacagaacgtagatcggaaaaggctcaatgagatcgtttcccgctggatccgcaaattcatccgcaaacagctcgcgcagaacttcggtcatgctgcgcagatcatagcggagcagctgcggtgtgtttgccatggcgagggcgtagaggtcgtctctggtaatcccccagtaagtgagatgttcattgtggatcaggaccgttgctgtgccggaagaatcagattccaccaggcataagaagacgatggcgagatccaaaaagcgatagtagggaacccgctttaacagttcgcggttgcgctcatagttgatcagcttcattgtgacgcgggattttaccttgtcatagtcggtgaaaaaagagatgtcaacaggggatttgggacggttctcccgataggcggtcagaatgtcgtctgtgatgtcggaaaacgatctgccgcgctcatactgtccatagtagtaatccagataaatggtgggcgccaggttctgaccgggcgcgagaatggtgagtccgtcaagatgggtatcgttgtttttgagaatgtctgaaacagtgatgcggacatcggagccgaggcggtccgagagagtagagatgatctgctgcttgaaatcgtggtaattcataaaatcctccgaatgaatggaggggaagtaaaatcgtacagatggggaagaaaaatccacatgaatgcgtagctgcatttatgtggatttaatttatcatatagaaagtcaaaaagcaattggacaatattactaaaaatgtcggatgctattcggactttaatgttttccagagatagctgtaaagctctggggtatcgctgccgagctgtttgtagaccgtgcagttcgcaaagacatcgtcaggaggaaagatcgtggtatcattgcgggtgtcctcgtcaagcgcatcgacgacggcctgatttggcgtggcgtagcagacgcagtcaaaattgagcatggcgacgtcctcgcggtacagaaaatccagaaacttttcggcgttttccttgtgtgtgctgtcagccggaatgaaccaggaatcgatccagaggttggatccctccttcggaaccgtgtaggagagatcggcgttggactccatggcggtggctgcctcgccggagtagacgagcgctaacgccgcattccccgcgatcatctcatctgcggtctcatccacataataagcgtagacgaggggtttctgctccaccagaagcgagagcgcgtcacgcagatcggtctcgtcctccgtgttgatgtcgcggcccagaagacggagcgccgggacaaaggaatcccggacggagttctgcatgatgatggtatcgcggtagcggtcgtcccacaggatgttccagctctcggtctcctcctcgctcaccatggtcgtgttgtacaggattcccagcgtgccgtaaaagtacggcatggaatactggttctgcgggtcgaagacctcggcggcagcaagaatagcgggatcaagattcttatagtaggagaaggaggaaaaatcaatcggcgccacttttccctcgtggatcagccgctccaccatataatccgaggtgcacacgacatcgtaactgatggaaccggcagaaaacttcgtgtacatctcctcgggactctcgtattcctcgagcttgatcttgatgccggtttcctgctcaaacattttgatggcggaggcatccagatatttgccgtagtttaacacgacgagggaattgtcgccggagctgccggcggtatcggtatccgcgctgccgcacgccgagagaagcagggcggcaaacgcggcggtaatcagtgcataatggaatcgtttcataagtaagtggcacctcctttaatggataccggcatgattcccggcgattctgtccgaacggcggttcatgacaagaagcagaagaaatgcaaacaaaatggttgacagggcgtacaattccgggcacacccccttgcgcagctctgtgtagagcatcgtcgacagggtgttgacgccggcacctttggtaaaaaaggcgatggaaaaatcgtcgagcgacatggtaaccgccatcaggaatccggaaaatacaccggatttgatctccggccaggtcaccttgtagaacgcgtacatcggagtggcaccgagcatgatggtgcggttctttttttttcatggcactgatgccgatcgcggcaagcgttccgatgacggtcgagacgatggctgcggtgagtgtgacctgtagagttgtcacaaacgcattcatgatggtctcgtccgtaaaacaggaagcgtaccatttgagtgtaaaaccgccccatacgacacgtgattttgaattgttaaaagagagcacgatgagtacgaggatcggtagatacaaaaataaaaagatgacggcaagatagatgcgctgtccccatttctttaccataccgcggtacctccttcgtctttatccagcacattcataagtgccatacttgcaatgacaaacagcatcagcacaacggacagtccggaacccagatgccagttggtgccctgcataaattcctgctcaatgacgtttccgattaagagcaccttgcccccaccgagcaggtcggagatgacgaacgaggtcagtgccggcacaaagaccatgacgattccgcttaacacgccggagagggtgagcggaaaaatgatttttacgagaacggtcagattgttcgcgccgagatccctggcggcttcgatgacgtccttgttgatccgcaccatggagttgtagatcggcaggatcataaaaggaagaaaatcgtacaccatgccgaacacaacggcggtcggggtgttgagcatcttcacatggccggtgccgacggcttctaaaatggcattgacaataccgttgttggagagcagaagtctccacgcgagaatgcgcagcataaaattcatccacatcgggaggatgaacaaaaagacgacaaagctctggtgacggaagcggaatgtgcttaaaatcatgcagagcggataggacaaaacaaggcagaacagcgtgcacagaaagccgagctttaaagagagaagaatcgacttgacatgcaccggatcggcgatggcggcgatattggaaaaggtaaagctgccgtccgccgcagtgatggcataatagagaataaatacaagcggcagaagaataaatccgatcatccagatcagataaggtcctgccagaagctgttttttgaagttagacatcgattcctgctgcctcctcgtcctcggattccggtttgttcataatctggatgttgaatggaatcacgcggatcccgacatgggttccgacggtgtaaaactgcgtggtgtccaccagccactcaaagccgcccgccatgatctcgatctcgtagtggacgcccttgaagatgacggaagtgatatcgccgtccataaagccttccccgggtgcgacgatctccacattctccggacggatgacgacgtcgaccggcgtgttggtgccgaatccttcatccacacagggaatcctggtgccgagaatctcaacgacccggtctttcatcatgataccgtcgatgatattgctgtccccgataaaatcggctacgaacgcgttgaccggctcattgtagatcatttccggtgtgccgatctgctggatgtagccctggttcatgacgacgatggtgtcggacatggtgagggcttcctcctggtcgtgcgtaacaaagacaaaggtgatgccgagctcgtttttcaggcggatcagctcatactgcatttcctggcggaactttaagtccagtgcgccgagcgactcgtcgaggagaagaaccttcggctcattgacgatggcgcgggcgatggcaattctctgctgctgtccgccgctcaaagaatcgatggagcggtgctcgaatccgtccaggtttacgagctttaaggcgtatttgattttgtcgtcgatgtatgccttgcttttttttctgatcttaagtccgaaagcgatattttccgcgatggacatatgcggaaaaagggcgtatttctggaatacagtattgagatcgcgctcattgggcgggagggcggtaatatcctttccgtcaaacagaacctggcctttgtcaggggtctcaaatccgccgataatgcgcagggttgttgtcttgccgcagccggacggaccgagcagtgtgatgaattcattctcacggatgtagaggttcaaatcgtccagaatgacattgtcaccgtaggatttggcaatgtgcataagattgatcagttttttgctcattcgggggagtcctttcttaatatatgcagaatgcacccgcatgtctgcgggagatcgatgatatgctgattttgcagtattttcatagcataagaaagattttattttaataattgaaaaaaagtagttgcaattttttgaaattccgttataataactcaatgtgatgttaaacatgacctgccgatatggctcagttggtagagcaacgcattcgtaatgcgtaggtcgtcggttcgagtccgactatcggctttaaataaaaactctcagtaattgtgctgggagatttttatttatatgctagttataacacatgcttatcaatgtttattagagcgggttatgactgagtgcaaaaggaggaaaatattatgaagaaaaaagtgattagcttactgctcactgcagcaatggcaaccaccatgttcgcaggctgtggttcttccagcgaggagaatacaactgcagacaacaatcagacagcagcaccggcagcgacagaggctgcagcagaggagagcacagaggcagctgctcctgcagtatccgctgatggaaagatcgcaatgattaccgattccggtgacatcacagacgagtctttcaaccagatcacatgggagacctgtgtggcttacggtgataagaacggtattgagtatcagtactataagccggctgaggacacagacgaggagagaatcaacgcaatcgaccttgcagttgcagacggtgcaaccgtaatcgttatgccgggttatctgttcggaccggcaatcgctgaggagcaggatctttatccggatgtttcctttatcgcagttgatgtgacagaggctgacatcgtagatctttccggcaacgcagtcggaatcagcgacaacgtatatatctgttctttccaggaggagcaggcaggttaccttgcaggttatgcggcagttaaggatggttacacaagccttggattcctcggtggaatcgcagttccggcagttatccgttatggttacggttatattcagggtatcaacgatgcagcagaagagatgggcgttgatgtagatgtgaaatactactatggcggtcagttctacggaagtgatgcgatcacagctcgtatggagggctggtatcaggatggcacacaggttgtattcgcatgcggcggcggtatctacacatctgctgttgaggctgcagagcagtacgacggcaaggtaatcggtgtcgatgttgaccagcgtccgaagatcggtgatctgtgcattacctctgctatgaagggcttaggctctgcagtgaactctgcactggatgcatactttggcggcaactgggcttccatcggtggcaagtctgagcagctcggtctggcacagggcgattatcttggtcttccgacggatacagattcctggggctttacaacatttacggtagatgagtacaatacagtattagacggactcaaggacggcagcatcactgtttctaacgatacagagaatcagccggaggtaggttctcacgtgaccgttgactatgtagagtaagcggactctttaaaggggaagagaaatagtttctcttcctcttttttttatatccagaagatgttatactataagatatgcaggaatgactcatgcggcgcatgaaaaaaaagaacgaagaggatacatgtatatggaaaacgaatatgttattgagatgttgaacatcacgaaagaatttccaggaatcaaagccaacgataatattaccctgcagttgagaaagggagagattcatgcactgcttggtgagaatggtgcagggaagtctacccttatgagtattctgtttggtctgtaccagccgacgtccggtacgatcaaaaagaacgggcaggttgtacagatcaatacgccgaacgacgcgaatgatctgaacatcggaatggttcatcagcatttcaagctggtggagtgtttctccgtgctggataatattatccttggtgttgagccatcgaaaggattgttccttgaaaaagatggtgccagaaaaaaggtactggagctgagtgagaggtacgggcttaaggtggagccggatgcgctgatttcggatatcaccgtaggtatgcagcagcgtgttgagattcttaagatgctctaccgtgataacgaggtgctgatctttgatgagccgacggcagtgctgacgccgcaggagatcgaggaactgatgaagattatgaagaatctcgcgcacgagggcaaatccattctgttcatcacgcataagctgaatgagatcatggaggtggcggaccgctgtacgatcttaagaaaaggaaagtacatcggaacggtcgacatcgcggatacgacgaaggaagaactttccaagatgatggtgggcagaaatgtaagctttaccgttgacaaggacgagaaaaagccgggggatacggtgcttgaggtatcgcatctgacggtggcaagcagatcacatgagaacaatgccgtgcgggatgtctcgtttcaggtgcgccgtggtgagatcgtatgtattgcgggtatcgacggcaacggacagacagagttggtgcaggggctgaccggactggagaagatcggagggggcagcgtgaaatttctgggacaggatatcacaaacaccacgatccgggagcgttccaagcatggtatgagccatattccggaagaccggcataagcacggactggtactggactacacgctggagcagaatctcgtgctgcagcgctactggcagccgcagtttgaacgcgcgggctttatcaagtcgggcgaggtgcgcagatatgcgcagaagctgatcgagcagtatgatgtgcgaagcggtcagggacctgtgaccattgtgcggagtatgtccggcggtaaccagcagaaggcgattattgcaagagagattgacaaagacccggagcttcttgtggcagtgcagccgaccagaggtcttgacgtaggcgcgatcgagtatatccataagcagcttgtggcacagcgcgacaaaggaaaagccgtgctgttagtctcgttggagctggatgaagttatggacgtgtccgaccgtatcctggtgatgtacgagggtgagatcgtaggagaactggatccgaagaaagtgactgtggaggaacttggactttacatggcaggtgcaaagcgggatgaggttgcaaagaaagcataaaggcgaggccttacagattaacagaaaggaaatatgacaatgagtgaaaagacaaaggatgtcctattgtccatctttgcatcgcttctttgcattgtgatcggacttctcgtgggacttatcatactttattgtatcaatgcagagaatgcattggatggtttttcaagaattatcaagggtggcttttacctcaaaccaaagggaatcggaagtgagattgcgcaggcgacaccgctgatcatgacgggtctttccgttgcgtttgcttttaagacgggactgttcaacatcggtgcggcaggccagtataccttgggcgtgttcggtgcattgtattttgcactgattctgcagatgccgtggtatgtatgtcttctggcagcaatggtctgcggagccatctggggtgctgttccgggaattttcaaggcgtactttaatgtcaatgaggttatcacctccatcatgtttaactggatcggtttatatctggtgaacgagctgatgtacagcacggtatccggaatgtacgaccagaagacgacgcgtacttacaagctgagttccgcagcaccgcagtcattgattccagattgcggcatgagcgctgtttttaagacaagctcgaccacgattgccatttttatcgcgatggcgatcgcaattatcatgtatgtggtactcaataagaccacattcggttatgagttaaaagcctgtggctttaacaaagacgccgcaaaatatgcgggcatcaatgaaaaacgcaacattgtgctttccatgacaatctccggcgcacttgcaggtatcggtgcgggactttactatctgtccggtgcatccgagtggaatccgcaggtgtccacagcgcttccggcgatcggtttcaacggtatcccggtagcacttttggcgctgagcaatccgatcggcgtggtatttgcagcaatctttgtcgcacatatctccgtgggaggcgcgtatctaccaaccaagtattatcagccggagattgcggatctgatcgtggcagtcatcatttacctgtgtgcgtttgttatgctctttaagagcgtggtcgtatcgaagctcagcaggaaaaaagcgaagaaggaggatgtgaaataatgttcttactgattaagtttacattactctatgcggtagtattgatgctggtggcgcttggcggtatgttctcggagcgaagcggtgtaatcaacattgcacttgaaggtatcatggcaatcggcggtctggcgggcgttttcgtcctggcactctgcggggattcccttccgtccggcgtgctggtggcggtgtccatcctggcaagtgcggtagcgggaattctctattcccttctgctcggattttccgccatcacgttaaaggcggatcagacaatcggcggaacggctttaaatatgcttgccacagcggtggcgatcgtagcggtaaaagcgttcaacaactcctcggcagcgggaaacggtgcggcttccgcaaagctttcctacagcaacaaggcatttatctataaaatcggaccgctcacgatcaacattttcctgattatcggaattatcattctgattgtaagctatgtatttttgttcaagaccaaatggggcttacgtctgcgcgcgtgcggtgaacatccgcaggcagccgattcggtcggtatcaatgtgtatcagtggagatataccggtgtcatgatctcgggtgcactcggcggaatcggaggcttcgcctacatcgttccatccgttaccacctggaactttgaggtcggcgtagcgggagccggtttcctcgccttggcagttatgattttcggacagtggaagccgttcaacattgcgggcgcagccgtgttctttgcggtattccgttccctggcgaacatcgcggattccaccgtgcttgcaaacctcggattgtccaagaatatctacagcatgatgccgtttatcgcatccatgattattcttgcgtttacatccaagaattcccaggcaccgaaagcggagggtattccgtatgataagggtgccagataggaagacggcgtaagagaccggaatttccggaagcgtccgggagcatatgataacaaacagaaaggattctaagatcatgatttcaagcaaatattttgaccatactattttaaaggcagaggcgacggagacacaggtggcaaagatctgtgatgaggcgcttgccaatgatttcgcatccgtgtgcgtgaaccagtattacacccgttttgtggcagagaagttaaaaggttctgacgtgaaggtgtgcacagtggtaggtttccctctgggaatgtccgacaccggtgtgaaggcattcgagacgaaggctgccatcgaggacggcgcacaggagatcgatatggtaatcaatgtcggcgcattgaaagacaagaagtatgactatgtaaaaaatgatattcataccttaaaagaagtctgtggcagcgatattgtcttaaaggtcatcatcgagacctgtcttctgacagacgaggaaaaggtgaaggcatgtgagctggcaaaagaagcaggagctgatttcgtaaagacttccaccggattttccaccggaggggcaaaggcggaagatgtcgcactgatgagaaaaaccgtgggcgatgatatgggtgtgaaggcatccggcggaattcacacggcagaggaagcacaggcaatgatcgatgccggagcaagccgccttggaacgagcgctacacttgctatcattgggaaatagtaatcaggagcggtaggatgaatacaattttgattggaattgcaggaggcaccggaagcggcaagacaacacttgccgacaaactgatcgacagctttggcgatgatgaggtgagtattctgcgtcatgataactactataaacgccatgacgacatgtgttatgaggaacggtcgaagttaaactatgatcatccggatgcgtttgatacagcactgttgtgtgaacatatctgtaagctgaaagcgggagagcagatttatatgccagtctatgactactcgatacataatcgttccgaggagaccattctggtaaaacctgcaccggtgattgtgctggagggcattctcatttttgctgagccgagtctctgtgatcttatggatatcaaggtatttgtggatacagatgcggatgtgcggattctgcggcggatcatccgtgatgtaaaggaacgcgggcgttcgttagacagcgtgattacccagtatctgacaacggtaaagccgatgcatgaacagtttgtagaaccgagcaagcgccgggcagatattatcatcccggaagggggagaaaatatcgtggcgcttgacatgctgattgaacgcgtacgcaaacatttaaagaataaataattagcgcaataaagtggcaggcactgtgtctgccatttttttatatgcaggattgctcggatgcagatgatcgccgctgtcatatccttccgcgaaagagcgcggatcatcggcggcacgaagtgcctgatcgaaatcgatacagccgtcgctctcgtggttggagcggatccagtcattgacggcaccgcgcagctcttcgcggaacggtgcgtaggtgcgccagccgtaaatcggcagaagggttccgagatagacgctgtcgtgaagctttctggcctcctcgatataccatttcagaccgtcgatcagttcggcggcagtcggcagatcactcatgggacggaacggattgacgtcggttccgaccggatggatgatgtcattgatgccctgctggatgatgacggtatccgcaccggcggttggaatttcgtgggcaaaacggttggttcccttaagaccgtaggaatcgtaggtgatacagtcgtactggcgcagaatacgcgtaccgcttgccgcacggcggatcaccgaggtatggttgtgcccttcttcgatgaggcgcagcgtcagatagtccggccatgcctgtgcggtgatggaatctccgtagcagataatggcatgacaatcttcctttgtcagaatatcgatgttgctaagaaaatagaaccagtttgtcgccttggaggtggcaaggggcagcgcttcgctgtgcgtctggtcgccgtaggaaaaatagccgcgggacaatggacctgtgatcagcacggcggactgcatggcagtgtagccgtcaaaatacaggctgacgcagagcgtctgaccggcagataccggaaaggagagtgcatcgctcgcggcggatgcacccgctgccagtgtgacggaatggctgccgtcaaaggtaatatcgcggatggtgcctgcagcaagcggacaggaaagaggaactttcccggtgagatcggaatcacacaccgccaccgttgcccggtggatggtgacaggttcctttccgcagtagttgtcgagcgtgaagcggagtgcgcttccggaaaaaggtgcatagaccggatagcgcagcgtcagatcttttgcgtagccttccggatgatgttctgcgatggacatggcattgccccacatggagacccattttgtatcattcataagtttgttctcttttctttattatttactggtaaggaatataagagtatattcctgcgttattatagcggaagtgaaggtatttttccagtggacttgttctttttttcgatccttgctataatgagcgcatgcgggtgaagacctgcagacagaatagaaagacaataaaggagttcatttgtatgggagagattgcaaatcgtgataataagaagatgctgattttgtttgcagaggtggttgcggcgcttgcgacgattctgatcgccgttttagcgatgaagattccggtggtgccggtgtgtgtgatcgttttgatcgaggtggcgattgctgcctgtctgcaggaggtaccggtgtgggtacacgccgtggtcgccgcagtacagctggttgccggggtactttgcggcagagccgtattctgcctgttgtgtattttgatctatgtgtttgcgatactgacactgcgggaagcaagagcgtaatgataagacctttatgaagcggatgcttggtaaaggtcttctttctgtcaaaggagaaaagatgttagagaaactttttttggaaatgatcgcatattacagcggagacccgaaacggatccagcattttacaaaggtacacagctatgcaaagctgatcggggagcgcgaacagctttcgccggaggaactctatattctggaagcagctgcatacacgcacgatatcggcatcaagccggcggaggagaagtatggaagcagtgagggaaagctgcaggagcaggaaggccctgcggtggcacgcgggatgctgatgcggctgggctttgcggagaatgtgattgagcgcgtctgctatctgatcggacatcaccacacctacacgggcatagagggcagagactatcagattctggtggaggcggattttctggtgaatttgtatgaggacggcagaacggacggagacggcgggtttgtgccggataaagcggctgtagagacggcatatcagaggatttttgcgacggagaccggaaaatggatctgccggagcatgtttgcacttggaggtgtgtcatgatgcaggaaaggaagcagaagggaaaaattctggtattcagttccagggaaatctgctatctgtccagcaactttttcgcaaatcagatcggcgcggcgtttgaggaactgggatatgaggtgacggtgtgcgaactctcaaaggaggatgatctggatgcgaagcttgcgcgctatatcggacagccgtaccgcctgattctggattttaattcccttctgccgcggatggtgttagacgacggcactccctatgtggaccgcctagcgggaccgttttttgactatattttagatcacccgctgtttcactatcagggactttcaagcggtgtgaaaaacctgcatgcgattgtcctcgacgaggcacagcagaagtacgtagaaaaatattatgaaaaggtggcgagcgttcacatgctgccgctcggggcgacaagagcagtctacgagggcacaaaagagccggagtgccggattttatttccgggaacgtatgacagaccggacgcggtttatcagattgtagagaatgctcccgagccgcttgggagcatgatgaaagatctgattgagcggaggcttgccgatcccacactgccgatggaggaagcattttcacagcagcttaaggaggagaaactggaacttcctgccggacagtttgcgctgtttatgaacagcatgtatgcggtggatgcctatgtgcgtgattatttccgcaaggcggtgttggacgcgctgctcgcggagaaactgccggttaccgtattcggggaaggctgggaaaaatattcctgcggggacgagcacagcctgcggcgcgagccggcggtgccgtttgcgctctcctttgagcggattgccaaagcccatgtgcttttaaatgtctcaccgatttttaaccggggaatgcacgaccgggttcctgccggaatggcgaatcatgcggtggtgttaaccgatgaaaatccgtatttaagaagaacgtttacagacgggaaggagctgcttttttattcgctggaaaaaccggacacgctgtgtgagcaggcggagagaacacttacggatgtaagacttcgtgagaagattgcggcttctgcctatgagacctttgagcgggaatatacatggaagcgccgtgcggagcagatcctcgcatttgcagaggaggtggaagcatgagagcacagaagaattatcagaaaatgctggaggcgacgatcgctggattaaaggagcagaaccgtgtgccaacgctgctgctgcacagctgctgcgcgccgtgcagctcgtactgcctcgagtatctgtcgcagtattttcatatcaccgtggattattacaaccccaatatttatccggaagaagagtatcatatgcgggtgcaggagcagcagcggctgattcgggagcttccggcaaaatatccgatcgcattccgggagggcgcctatgataaggagcgtttttatgagatggcgcgcggaatggaggaggaaaaggagggcggcgaacgctgcttccggtgctatgagctgcgcttgagagaggcggcggagaccgcaaaaagccttggcatggattactttaccacgacgctgtccatcagtccgctcaagaatgcggaaaaattaaatgagatcggggatgcgctggcggaggaatacggcgtggcatatttgaattctgacttcaaaaagaaaaatggctacaagcgctcggtagagctttccgaacaatacggaatgtaccggcagtattattgcgggtgcgttttttccaagcgggagcgcgatgcccagattgctgcaaaagcggcggcacagggaatttgatgcggtaaagcatgaaaggacttgcgggaagcgcgaacttcatgtagaatgataggaaatgtagtgaaagcgaggtttttaaaatggctcagttatggggaggacgttttaccaaacagaccgacaagctggtctataattttaatgcgtctatttcgtttgaccagaaattctataaacaggacattgagggaagtattgcacatgtgcggatgctcgggaaacagggaatcttaaccgaggaggagatgcaggcgatcgtcgcatgcttaaaggaaatccttgcggatgtggaagccggacgtcttgttataacggatgaatatgaggatattcacagctttgtggaggcgaatctgatcgaccgtctgggagacaccggaaagaagctgcataccgggcgcagccgcaacgaccaggtggcgctcgatatgcgtctctacaccagagaagagctgctccatgtggatgcgctcttaaaggaactgctcggcacgatattgcatatcatggagcagaatacggagacgatcatgccgggtttcacacacctgcagaaagctcagccgatcacgctcgcgcatcacatgggggcctattttgagatgtttaagagagaccgcctgcgcctgcatgacatctacgagcggatgaattactgtccgcttggttccggagcgctcgcaggcaccacctatccgcttgaccgtgcatacacggcagaactgctcggtttttacggaccgactttaaacagcatggacggcgtgtctgaccgcgattatctgatcgaatttttgtctgcctgcgccacgatcatgatgcatctgtcacgcttttcggaggaggtcattatctggaattccaacgagtaccagtttgtggagattgatgatgcgtacagtaccggaagcagcatcatgccgcagaaaaagaacccggacatcgcagaattagtcagaggaaagaccggacgcgtctacggcgcgctgatgtcgcttctcacgacgatgaagggaattccgcttgcgtacaataaggacatgcaggaggacaaggagctttcctttgacgcgatggacacggtcaaaggctgtatcgcgctgtttaacggcatgctcgccacgatgaagttcaacagggagcgcatgcgtgcttcggcgaacggaggctttaccaacgcgacggatgccgccgactatctggtgaaccacggggtgccgttccgcgatgcacatggaattgtgggacagatcgtgctttactgcatcgaaaagggaattgcgatcgatgatatgagcctggaggagttaaaggcaatcagtccggtgtttgaggatgatgtctatgaggcgatctccatggaaacctgcgtgaacaagcgtctgacggtgggagcaccgggaaaagaggcgatggaacaggtgatcgcagcggagaagaagtacctggaggaagagtggaagcctcttgaaacttcaatacagtaacgtgacattgtgagaaatgtacaagaactgtcaaaaaaagccgggaagttttacgaaaaaagcattgctttttgacgggaaatggcataatatattcactatgacgacacttgttcgccaccgacggacacgaacagtgcaaaaagcaggtacgtgtgatgatccggcagaggcaatgagaggcggagtcgtatgccacagcgggtgtcataagaaaaagatgaggagattagaagagtcatgagtgaaaagttgagagttggtattctgggtggtacaggtatggttggtcagagatttatttctctgctggagaatcatccgtggtttgaagtgacaacgatcgcagcgagcccgagaagtgccggtaagacttatgaggaggcagtcggagaccgctggaagatggacacaccgatgccggaagcagtgaaaaagattgtcgttatgaatgtcaacgaagtggagaaggttgcggcagaggtcgatttcgtattttccgcagtggacatgacaaaggaagagattaagaagattgaggaggagtatgcgaagacagaaactccggtcgtttccaataacagcgcgcaccgctggacaccggatgtgccgatggtggttccggaggtcaacccggagcatatggaggtcatcaaataccagaaggagcgtcttggcacaaagcgcggtttcgtggctgtaaagccgaactgctccattcagtcttacgcgccggtgcttacggcgtggaaggaatttgagccgtatgaggtggtggcaacaacctatcaggccatttccggagccggcaagacctttaaggactggccggagatggttggcaatatcattccgtatatcggcggtgaggaggagaagtcggagaaggagccgcttcgtatctggggacatgtggacccggagaagaaagcgatcgttccggccaaatccccggtcatcacctgccagtgcatccgtgtgccggtgttaaacggtcacactgcggcggtgttcgtaaagtttaagaagaacccgacaaaagagcagctgatcgaggcacttcgcaatttcagcggtgttccgcaggagttaaagcttccgagcgcaccggagcattttatccagtatctcgaggaagataaccgcccgcagatcgctctggatgtcaactatgagaacggtatgggtatctcggtaggacgtctgagagaggacacggtctatgactggaagttcgtgggactgtcccacaataccgtgcgcggcgccgcaggcggtgcagtgctctgcgcagagcttttgaaagcacagggatacatcacagcgaaataaagaataaaaaagaatcctgcttgcaggattcttttttatttcataggaaatagcgtgatacgttaatgtgtgaaagtagaacttccctatgaaaataaaaaacgctccgcgaggatgcgcagctcgcggtaaggaaaatatcgctttgcgaaccgcttgcgcgcggagaatttcgcaagcgagattcttttttattgcccggaaagttaaaaaatgatataatttccgcagaacatatggacagatagaatgtgccggatatgggatgcggtgtggcttttcgtgcccggcaggaaagtgcagaggagaagagatggtcgtaaaatcgtcggtgttaatggaactggaagagtgctaccgggaaccgggcaatcagctggttgtgctgtacgggcggacggactcggagaaggagaggctgcttagcgcatttgtgcagaacaagaagcatttttattaccgcgcgagacaggtggcggagcgagagcagcgcgcgcagatggggcgtgaactgacggcgcggtttgaggtgatgctgcagaagtatacctatgaggaatattttaaccgggtaaagagcggtgatcccacgaagctggtagtcgtgatcgatgaatttcagtatattgccaaaaaggatcctacttttatggaggcggtgctgaaactgaaagcgcacaggctttatccgggacctgtgatgattctgctctgcagctcggcggtgtcatgggcagagcgggaacttccagagtgtatcggtgaggcggcatgccgcaaaatagaccggaaaatcaaatttacgaatctgaattttctggaagtggtgcgggcgttgcccgagtatccggtggcggaatgtatcaagacttacggcatcatcggcggtgtgccgggatacatcaaccgctggaacgcaaaagcggatgtaaagaccaatatctgtagactgattctttcgccgggcggctatctgtaccatgcggcggaagatctgatcggggagagtctgcgggaactgtctgtctatgagaccatcctggcgcagatcgcggccgggcaggacaagctgaatgatctgtaccggacgaccggattctcgcgcgccaagatcagcgtctatatgaagaatttggcggcatttgatatcatccagaaggtggtatcgtttgagacgggcggctgggagaacacgaagaaaggtgtgtatcggatctgcgacaattatgtgaatttctggtttcactttatctatccgcatctgtcggatttgtatatgacccgcccggaagaattctacgacagatatatcgcgcccggactggatgcgtacctctcccggtattttgtggaggtatgcatggaatatctgggacttctcggtatggtgggaaagcttccgcttaagattgcacgcatgggaacctgggttggcaaagaggggaatatcgacatcattgcgcagaatgagattcgacagaatatggtcggactctgcaactggcaggaacccgagcttacgatggaaatgtgcgaggcgctgttccttaacatgaagcgggcaaaaatcggcgcggaatattatttcctcttttccgcacagggatttgcaccggaggttaccgccatggcggagcgggataagcggttcgtgctcgtggatatgaatgaactgtaagttgcccgatgtcgagaaaaatgctataatttgcttcatgcgaaagtaattggaggaacagattgtggcaaaatctttgatcatcacggagaaaccgagtgttgcgcaggagttcgcgcggattctcggcgtatccggaagaaatgacggttatatagagaacgacgggtatgtcatcacctggtgcgtggggcatctggtggagatggtgtacccggaggagtatgatgagcggtataaaaaatggcggctggaagatctgccgtttctgccgcgggattacaaatataatgtaatcccatctgtgagcaggcagtatgatgtggtacataaaatgctgcaccgcgaggatattgacacggtctactgggcaggagatgccggaaaagaaggacagacgatcgaggaaaatatccggaagttcggcggcgtgcgcgagggcatgaaggagctccgcgtctggatcgattcgcagactgaggaggagattctgcgcggcatccgtgaggcaaaagatatgtcggagtatgacaatctcgcaaagtcgggtgtgatgcggacgatcgaggattatgcgatgggaatcaatttttccagagccatgtcggtaaagtacggaaaacttctgaatgatgcggcgggaacatcgagctatacggcgatcgcggtcggccgcgtcatgacctgtgttcttggcatggttgtgatccgggagcgcgagatccgcaattttacagagacgccgttttaccgtgtcgtgggaacctttcatcccgaaggagaggaagaatgccggatcacggcggagtggaaggcaatagaaggctctaaatattttgagtcgccgcttttatataaggaaaacggctttaaaaaggaagagagcgcgcagacgctgattgcggagttaaagggacaggaagcgctcattgattccgtggagacagggacgcagaaaaagcgtgcgccgctgcttttcaatcttgcggagctgcaggcggagtgttccaagcgttttaagatcagtccggatgagacgctgcaggtggcgcaggatctgtatgagaagaagcttaccacctatccgagaacggatgcacgtgtgctctcctcggcggtggcaaaagagattacaaaaaatatcagcagactgaaaaattttgcgccggtggctccttatgtggagcgcatcatgaaggaaggccgctgccggaacattgcgaacacgcagtatacggatgattccaagattaccgaccactacgcgatcattccgaccggacagctcacagagctggaatctttaaacagtcttgaacgaagcgtctatgagatgattgtgcgccgtttcttaagcattttttatccgccggcggagtatcagacggtgaagcttgtcgttgcggcaggcggtgagaagctttacacttccgcgaagcagttaaaggttccgggctatctggagattgcaggcattccgaaatcggcgaaggagcggaatgcggcgaagacggacggggaggagcagacgcagggcggtgatgctgaggctgcacaggaagaagaggagaacgccgggcttttggcgtatgccgacaagcttcaaaagggagagacgcttttttcggacggctatgtcatccgtgaggggaagacctccccgccgaagcgttacacgtcaggatcgatggtgctcgccatggagaatgccggacagctcatcgaggaggaagaattaagagagcagatcaagggttccggaatcggtacatctgccacgcgggcagagatcatcaaaaagctggttcgggtcggctatctgaatctgaacaaaaagacgcaggttctcacgccggagcggctgggggaaatgatctttgaggtggtttcgatgacggttccggcactgctcaaccccaagatgacagcttcctgggaaaagggactggacggaattacgcggggagcggtcgtgatggaggattaccgctcaaaactggaggattttatccgcagggagacggtcgccatgatcgagcaggatctgaccggccagattgccacgcggatccacccgctcgtcggaaagggcggaaaggggcttgcggcgaagcgcagcctcggcattccctgtccggtgtgcggaggaacgatcgagacgacgccgttcggttacgggtgcagcaattatcagaaagatggcggcggatgccgcttctccatcggtacaatcgccggaagagacttaaacgatgaggaagtaaaggagcttttgaccgaaggacataccggcgtgctgtccgggtttgtctcgaagtcgaagaaaaagttctcggcgagcctcatcctggaaaaggatgatgagggaaaagtttcggttggatttgatttttcaaagaaccagccggaaatcctggagggtgtcgtatgtccagtgtgcggttctgccgtggagatcacgccgtttggctatagctgcgtcaagcaccacgagcatcccgatgaatgttatttttccgtgggaaagatcgcgggaaaggcgctgggcgtcgatgatctgacggagcttcttacgaccggaaagaccggtctgatccgcggctttactgccaggaataaaaagaagttcaatgcctgtttaaagctggagcagacggaggacggaagaaagaatattgcatttgatttttcacagaacgatgccgccgttgttcccgatgtcgtgtgtccgatctgcggcggggcgattgtggagacgtcgttcgggttcggctgcgcgaattacaggcaggatgacccggacagctgccggtttgcaatcggtacgatggcgggaaaggacttaaacgcagcgcaggtgaaggagcttttaaatcaggggagaaccggaacgatccgcggattcaagtcgaagagcgggaagaagtttgacgcctgtgtcgctctggaacacacggaagacggaagaattgaattgagatttgattttgaacatgtcgaagccaaaaagatcaaggatgtggtgtgcccgatctgcggcggtgatatcgtggcgacgccgttcggctttggctgtgccaattatgtgaaggacgatccgaacagctgccggttctctgtcgggaagatggcggagaaggcactgacggaagcgaacgtaaaggagcttctgaccaacggaagaaccggaacgatccgcggctttaagtcgaagagcgggaagaaatttgatgcgcgcgtcgcactggcaaaggatgagaagggaaaggtcacggggctgaagtttgattttacggatctggaagcgccgaaggtaaaggatgtaaaatgtccggtctgcggcggagatatcgtaaagacgatgtttggatacggctgtgccaactattcaaaggagaatccggacagctgccggttcgcaatcggcaagatcgcgggtgtctcattaaaggaagcacaggtaaaggaacttttgctccgcgggaagacggacgtgatcaagggatttgtggcgaagaccggcatgaagttcgacgcgccgctgaagctgacgccggaagggcagatcgcatttgattttccggagaagccaaagcccgtcgagacaacacttgcctgcccgaaatgcgggaaaatgttaaagaagagccagtggtattacgagtgtgagtgcggttttaaggtctcccacacggtggcgaaggtggcgctgaccgaggaggtcatgcgcgaactgttagagacagggaaaaccaaagataaagtgaccgggtttgtgtcaaaagccggcaacacgtttgacacctgcctaaagctggaggatgaccgcattgtgtttgattttgacaatcccggcacaaagcgtgagggtgcttccgacggcaagggcggggagcgcatgttctatgaggaattagaagaaaatgcacagccgcagccgctggcggctgaggacggcgcacagtacattgaggaggacgtgcctccgttttatgatgcgatggcggaggagtatgcggcttacgaggaggaagaggcaaaacagcaggcggctgcatccaattttctggatgaatttcctggatgagaaacgaatgagaaaagaaagtaaaaatcggatggcgtgcggtgcatgcttgctattgacagccggataaaatgtcattaaaatttgagtagttattgatagaatccggcagaagacacaggaggaaacagggcatggagtacaatgagcaggcctttaaagagaaagccaatttaaaggcaatgaaagtatggctggctttgattgcgattatgacactgtcatacggaagcgacctttccaagggaatctatacggcgacgcagtatgttgtttttctggttatggcgtgggtgccgtttgcaatcggactgctgacgttgaagttaaaggggagagcgacaccgtgttataaggatgtcctggctctcggatatggctttttctatgcctatgtggtgtgtatcacggactcggcgaccgcctatgcatatattctgccgttgacgagtatgttgattctgttcaaggatcgcagttatatgatacggtgcgcggtcacaaacgagatcgtcattgtgctcagtgcactgctccatgtcttcctcggcctgaatccgaatgtgaaaatgacagactattacctgcagttttcaacactgcttctgtgttatatctgttatattctttctgtcgaccacttaaatgagtcggacggagcgctggtggcatcgatccgggataatctgagccgggtcgtgacgacggtgggacaggtaaagggagcgagcaactcgattgtggacggcgttacggttgtgcgtgagctggcggatgagaaccggcagggagcggattccgtcgtaagcagtatggaggaactcacccggaacaacgatgttctccacaataagacgatgtcctccatggaccggagtaccgacatcagcacgcaggtgcagaatgtggcgggactgatcgatgagatggtgacgctgatccaggagtcggttgagcatgcggatgtgagtgcggaagaacttgcggatgtcatgaatacgacggataccatggcggcgctttccggcgaggtcgagcaggtgctcgagaactttaagcagaaatttgaaatggtaaaggaagagacgggtaccatagagggaatcacgttccagacgaaccttctggcactgaacgcttcgattgaggcggcgagagccggggaagccggaaagggctttgccgtggtggcaggtcagatacaggatctgagcatgggaaccaagacttcttccggacgtatcagggacgcactggatcatctggaggagacttcggagaagatgacggaatccatcaccaagacgcttgagatgatccgcatgacaagagagaagctcacgcaggtgcaggagagtgtcacaagcattaccgatgattccaaaaagctgggacagaatatcggggtaattgacggcgctatgaaggaagtggaagcttccaacagcgacatggtggagaacatgaagcagatctgcgataccatggaggtcatgacggagtgcatcaaccagtccgacgaagcgtcccgcacgatgctcagcaaatacgaggagtcttccgtcaatgtggataagattgagagtgtggtaggaaagctcatggaagaactcggtagcggcggattcatgggaattggcgatgcgcagccgggaatgcatgtggtgttagtcgctaagaacggagcacaggcagccgggacggagttccacggggaagtgtttgagagtcagagcgacggagttctggtaaagatcaagccggaagccggaaaaacgattgagataaagaaaaaagacattacatatgaactgcagatctgtgtcaacaatgcactgtatacatgggaggatgtcagcgtatccgccgcttccaatgcgggtgccgacagctaccggattgctgtggcgacaaacccgaaggtcatcaaccgcagaaagtatccgcgtatgccggttgccaatgcatgtaccgtgacgctgaaaaaatccggcaaagcttacaacggcaggatgatcaatatcagcgcaggcggtttcgcattcagcgcacatcaggaggatttcgcaaatgcgatcgggcaggatattttgctggaaatcccggacttcccgctggaggaggcacggacgctggacggacatatcatccgcagtacggataatgatggtgagttcattgtcggatgccgtatgccggaggacagcgaagagatccaggcttatgtcaataaaaattacagggaatagagaggaatttgtgtgatggaaacagcaaaaatcagccagttatatgacttaggggagacgattgcggcggaactgtttgcgggactgacctatccgtgggaggctctgccgaaaatcagcggctttataaagaagctgggaccgacgcttgacccggaggtctatgagcagcgcggcgagaatatctgggtggcgaagagtgcgacggttgcaccgactgctttcttaaatggacctttaattattgatgaggatgcggaaatcagacactgcgcttttgtcagggggaatgccatcgtaggaaaaggctccgtggtgggcaattcaacagaattgaaaaacgttgtgatttttaattccgtgcaggttccgcattacaattacgtgggagattcgattctcggttacaaatcccatatgggtgccggctcgatcacttccaatgtcaagtcggataagacgctggtggtggtaaaggatcatgatgagaaaattgaaacagggttaaagaaattcggagcaatgctcggcgactatgtggaagtcggctgcaattccgtgctgaatccgggaaccgtcatcggaagccacaccaatgtttatccgctttcgagcgtgcgtggcgtggttccggcaaattcgatttacaagaaccgcagcgaggtagtggaaaagcggtaggacaacagaagagggacagagacaatgaagagaagatgggtgcagggaatgcttcttgcaggaatgctgattttgacaggatgcggcgcaaagaacagttcacctgtggagaacggtaaagattatacatggaacgacattacagtgatgcttccggaagactgggcggaccgctgtacgatcaaagaggatgagaatggatttaccatctatcagacggcttcctatgagaagatggaaggacttggctacctgtgttcctttgaaaaaagcgacgcatggatgaattacggtgcgggagagaacctgatcgcctacacggaggacggaacgctgtattacctgatgcagccgacggatgttgcgtgcgatacggaggatcagacaatcgtggaagagtacggatccatgatggaggaggtcacggccatcgcatcaagtgtgaagatcgatgcggatgacgttcattacgatgccgatcagtatgtcgttccggttggcgcaatactgccggtgacggaggagaatctgtcggatctgtcagagcaggaactctatctggcggcaaacgagatttatgccagacatggaaaaacctttgatgacacctacctgcaggcgcattttgatgcgtgcagctggtatacgcccgccgggggagcgactgcaggcgatgcgggattaagtgagattgagcaggcgaatctgaaactgatcaaggcaatgcagacggcatatgaagcggaacatatatatccgaaatcctattcggcaggcgagaccgcagagatcgctcttttggacaatggagttcttaacgaagtcagctacacggtaaccggtaagggggagcaggtggtctgcacgctcacgatcgacgggacagcgtacgaccttgccgagtacattcagatgcacgcgccggttgaggatgcgttttatgtgacagaccttgtggagaacatcggaacaccggaagaggatgatggtctggagattgccgtacttgatgaaggaacagatggcatcggggcgacccattttttcaaatatgatggagatctttactatctgggagaggtcggaggattcccgttccgggaccggaatgccggattcagcggttttaacggccagggcggtgtgatggatctgatccgttacgacaagccggcagactgcatcctgcaggggtatgcctggtacaacagttcggagaagaagatcgagcatgcggacggcgggctttattcctattacgagccgtgtaagctggagcataagggagcactgaccgtgtatttttcgatggatgagacatcagcagaacagacgattgcggcaggggaggacatctactgtatccggtcggacggagacggttggatgtatgtgcgtgcaaaagacggaacggaagggtttttacctgtgacgcaaatgtaagaaaagcagctgttttgacaaaagtgcataaaatttgcagtacccacttgtgaaaatcaagaaaatgtgagagaataaatgcagtatgttaaatgtgtaacaatgtttaacaactcagttctatttatgcgaaaggagtcttaaaatgatttacactaaggaagttgaaaacatgtgcccagtcgcaaagggcgcaaaacatgaaccagctccgattccggaagaaggcaagtgggttcattccaaaaaaattgaagatatttcaggctttacacacggtgtaggctggtgtgcacctcagcagggtgcctgcaagctttccctgaatgtgaagaatggtgtgatcgaagaggcattagttgagaccatcggatgctccggtatgacacattctgcagctatggcagcagaggtattacagggtaagaccatccttgaggcactcaatacagaccttgtctgtgatgccatcaatacagcaatgagagagttattcttacagatcgtttacggtcgtacacagagtgctttctctgatgatggacttgcaatcggtgccggtcttgaggatttaggaaaaggacttcgttcccaggttggtaccatgtacgcaaccaaggagaagggcgttcgttatctggagatggctgagggctatgtaacaggtatcgctcttgacgagaacaacgaggttatcggataccagttcgtttctcttggaaaaatgactgacttcatcaaaaaaggcgatgatccgaacactgcttgggagaaagcaaagggacagtacggccgtgtagcagatgctgttaaaatcatcgacccgagagaagagtaggaaaggagacggacgaaaatggcattatttgaaggatatgaaagaagaattgaccagatcaacgctgtattaaacagctatggtatcagctccatcgaagaggcagagaagattaccaaagatgctggtttgaatgtatatgatcaggtaaagaagattcagccgatctgtttcgagaacgcttgctgggcttacacagtaggtgctgcaatcgcaatcaagaaaggatgcacaaaggctgctgatgctgctgcagcaatcggtgagggtcttcaggcattctgtatcccgggttctgttgctgaccacagaaaagtaggtcttggacatggtaaccttggtaagatgttattagaggaagagaccgagtgcttctgcttcctggcaggtcacgagtctttcgcagctgctgagggtgcaatcggtatcgctgagaaggcaaacaaagtacgtcagaaacctctgcgcgttatcttaaacggtcttggaaaagacgctgcacagatcatctctcgtatcaatggatttacattcgttgagacacagtatgactacaaggcagcaaaattaaacgttgtatacgagaaggcatactccaacggacttcgcgctactgtaaagtgctacggtgcagatgacgttcaggaaggtgttgcaatcatgcatcacgagaacgtaggtgtttccatcaccggtaactctacgaacccgacacgtttccagcatccggttgcaggtacatacaagaaagaatgtatcgagcagggtaagaaatacttttccgttgcatccggcggtggtacaggccgtacccttcacccggacaacatggcagcaggtcctgcttcctacggtatgacagataccatgggacgtatgcactctgacgcacagttcgcaggttcctcttccgtaccggctcacgttgagatgatgggtctgatcggaatgggtaacaacccgatggttggtgctacagttgctgttgcagtaagtgttgaggaagctcacaaagctggtaagttctaagtagtatcgtatttaattgaaaagcagggaatatactttaagcggtatgttccttgctttttattctataaatttcttgattttccagtgaagatctttctcaaagctttgaaaaaatcccttgccaaaccgcgcacattcgtgctatgctactttgcaacagtgcagtattacatggagaggaatggaacggttatgctaaagatcattgatgattttgtctggggagttcccctgatcgtgctgatccttgcggttggcatatttctgacgatccgtctgcggggacttcagatcacgaagctgccgcttgcggtcagacacattattgcaaacgaaaaagacggcaaggacggagaggtgtcgagtttcggcgcactctgcacggcgctgtcggcaacgatcggtaccggtaatatcgtgggagtggcgacggcggtcgtggcaggcgggccgggcgccttgttctggatgtggattgcggcgctgtttggcacggcgaccaagtatacggaatgtcttttggcgatcaagtaccgcgtggtggaagcggatggacatgtggtcggcggaccgttttactatattgagaacggtatgggcagaaaattccgctggctgggacagatcttcgcattcttcggcgtgggagtcggtctgctcggcatcggaacctttacgcagatcaacggaattaccggtgcggtaaagggcttttttgatccggagacggcatgttcggtgcatctgtttagcaacacctattcgtggagcgttgtgatatccgggctgatactgaccgtgtgcgtggcactcgttattatcggagggattaagcggatttcctccgtggcacaggtggttgtgccgtttatggcgcttgtgtatgtggtgactgtgctgatcattctgctgacgcatttgggagagattccggcagcacttgccaccatcgtacaaagcgcgtttggactccgtgcagcggcaggaggaacacttggcgcaatccttgttgcgatgcagaagggaatcgcgagaggtattttctccaacgaagcggggcttggaagtgcgccgatcgctgcagctaccgcgaagaccgatgagccggtggcgcagggactggtatccatgatgggaacggtgatcgatacgctgattatctgtacgatgaccggattgtccatcatcatcacggatacgtggaacatcggtctggacggggtggatgtcacgacaagagcgtttcagatcgggcttccgttcccggaacgcgtctcctcgtttttactgatgctgtgtctggtgttttttgcatttacaacgatccttggctggaattattacagcgagaaatgtctggaatatctggtgggcaaccgtcccggggtgttaaaatgctatcgctggctgtatattctggcggtattgatcggaccgtttatgaccgtgtcggcagtctggacgattgcggatatttttaacggactgatggcgctgccgaatctgattgcactggtggcgctaagcggtgtggtggcagccgagacgaagcagtattttgcaaaacagaagaatttttgatggttttgccaaaggacagagtaagttgttggatactctgtccttttttctgctataatagagaaaaaaggagggcgcagatggacgaagcacacgtgtatattgcaattgatttaaagtctttctatgcatcggtagagtgcgtggaacgtgggctggatccgcttacgaccaaccttgtggtggcagaccccgagcgcacggaaaagacaatctgtctggcagtatcaccttccctgaaagcctatggcattccgggaagagcgaggctctttgaggtcgtacagaaagtaaaagaagtgaatgctgggcatccgaaagagcggctgacctatcagatcgcaccgccgcgcatggcgctctacatggattacagcaccagaatttacaatctctatctgcgttatgtggcgccggaggatattcatgtctattctatcgacgaggtgtttatggatgtcacgcattatctggggacataccacatgacagcgagagaacttgcggcgaaaatgatacaggatgtctttgctgagacgggcatcacggcaaccgccgggatcggaaccaatctctatctgtgcaaagtggcgctcgatattgtggcaaaacatgtaaagccggatcggaatggtgtgcgcattgcaaaactggacgagatgagttaccgcagactgctctggaattaccgtccgctgacggatttctggcgggtaggacggggctaccagaagaagctggaggagaacggtctgtatacgatgggagacattgcgcgctgctcgctgggaggagccagagagttccacaacgaggaattgttataccggctgttcggcatcaatgcggagctgctcatcgatcatgcatggggctgggagccggtgacgatggaacagattaaggcgtacagaccgcaggtgaacagcataagttcggggcaggtactgcattgcccctacgacgcgaagggcgcgcggctggtggtgcaggagatggcggatgcgctggcgctggatctggtggaacggcgtcttgtgacggatcagcttgtgcttaccgtcggttatgacattgaaaatattacaaatccggcactttatgcagactatcgcggagagattgtggcggaccgctacgggagaaagattcccaagcatgcgcacggtacggtcaacctgaaaaccagaacctcctcttcccgtaagattatggaggcggtgatggggctgtatgacgacattgtgaatccaaagcttctcgtgcggagaatcacgcttgtgggcaaccggctggtggaagaagcccgcgccgaggcggaagaacaatacgaacaactggagctttttacagatacaggcggacaggaagaggagaaaaaacaggaagaactgcggctgaaaaaggagcgcagcctgcaggaggcaatgctttccgtgaagaaaaagtacgggaaaaacgcgatgcttaagggcatgaatctgcaggagggcgcgaccgcgatggagcggaacagccagattggagggcataaggcataatgggctgggatcatgcggcagaggaacacaaatatgacgatatacggatgcttgtgcatcacagatcgcgcgtgcatccgccgatgtccctgtgggatcgggcggcgcagttctctccgtttgccgcgttgagcggacacgaggacgcgatccgcgagacggcacgtcttacgacggagcgcgcagagctttccgagagccgcaaagaggagttaaacgagcagctcgtctggctgcgggagcacccggatgcgagagagcgggtgacggtgacctattttcgcccggacgcgaaaaaagcgggcggtgcctatgtgacagtcaccggagcggtaaaaaagatagacgaatacgaaaagacgctttggatggaagatggaaccgtcatagcgattgaggaactgtctgcggttgagataccggggaaggaccgatatgaggaagaatagaaggagcagcatgaagatggaaacacaaagatacctgtatgagacacatatgcatacatcggaggcaagcgcatgcgccggcagcacgggtgcccagatggcgcgcgcctacaaagaggcagggtacaccggcattattgtaacggatcactttttttacggaaatacttcggtggaccgttccctgccgtgggaggagtgggtacggcgcttctgtctcggatatgagcatgcaaaggcagagggggaacgcatcgggctctcggtgttttttggatgggaagcatgttatgaggggacggagtttttggtatacggactggatcaggcatggctgcttgcacatccgcagattaaggatgcatcgatcgaagaacagtacgcgctggtacatgagggcggcggcattataagccatgcgcatccgttccgggaggaggattacattcccgaaatccggctgtttccggaatatgtggatgcggtggagggcgtaaacgccatgcattcgagcagggcgagcgactgccacaagaacccgctgtttaacgagcgggctctggcctatggaaaagagcacaatctgccatttacagcgggatcagaccagcacaccacgcatatgatcggcggcggtatggtctttcccagaaaactaaaagacgtccatgactttacccgcgcggtgcttggcagagaggcggtggaactgttggacggctgcaaaagcgagtgattacgagcggttcttttcccggtattctttgggcgacatgcctttctgccggtgaaaggttttggaaaaatagagactgttgtcaaaccccagcgagtttgcgatcgcggtgatcgacaggctggagtgctccagcagatagcacgcctgcttcatgcggaaatccgtcaggtattccttgggggagcgccctaggacagcctcaaacgagcggaacagatgactgcggctcacgccgacatagccagcaatatcctccacggtgatggcgtaggaataatttgaggagatgtactcaatgcttttttgtacatagctgttcgcggaattctggctgccggcgtgcgtagcaccgtgcatgaacagggcgagcatggtatagagacgtcctgtcatctccaccgcgtgctcgaattcgttgccgcgtgcatcgtagatgtgcagaatctgccggtgaatatcattgccgcgtggggtgtcccgtataaaaggattctcaggggagaagtccgtggccttcaggatcatggaggcgtcgcttccggtaaaaccgacccaggcatactcccaggggttctgctcatccgcgcagtagacaacctcggtgtttgggtagaccaaaaaagtatctccgccggacagatggtaagtctgaccggcgacgcggtaggtgccttttccggaaatgatatagtggatcagatagtgatcgcggataccgggaccccattggtagagggcgtcacatttctggaagccgacgttgtagacggagagggaaaccagttctttttcggtcactttgtaggaatttttgtaatgatgcggcatagaacacactccttgtctttctgacagtaaaatccttatcgtataagtccattataaaaacagaaaagccgaaaagcaacattattacatatatttcatacattttgggctatacattttacggaggatagagtaatataattttcgtaaggcagatggaacaatgaatcataacggggaaaggtggaatcattatgacgattttagtaacaggcggagccggatatatcggcagccatacatgcgtagaattacagaatgccggatatgacgtggtagtgctggataatttaagcaatgcctccgagaagtccttacagcgtgtggaggcgctgacaggaaagccggtaaccttttataaaggggatatcttagaccgtgatatcctgaacaaaatctttgcggagcacaagatcgactgctgtatccattttgcgggattaaaggcagtgggcgagtccgtggcaaagccttgggagtattacaacaataacattgcaggtacgctgacactggtggatgtgatgcgtcagaacggctgcaagaatatcattttctcctcctcagcgacagtatacggcgatccggcagagatcccgatcacggagaactgcccgaagggtcagtgcaccaatccgtacggatggacaaagtccatgttagagcagatcctgaccgacatccagaaggcagatccggagtggaatgtgattctgcttcgctactttaacccgatcggtgcacacaagagcggcacgatgggagagaatccgaacggtatcccgaacaacctcatgccgtatgtaacacaggtggctgtcggaaagttaaaagaactcggtgtattcggcaacgattatgacacaccggacggtaccggcgtgagagattacatccatgtggtcgatcttgccatcggacatgtgaaggcactcaagaagattgaggagaaagcgggactctgcatctacaatctgggtaccggacacggctacagcgtgcttgacatcgtgaagaattttgaggctgcaacaggtgtgaagattccttatgtaatcaaggcgagaagaccgggcgatattgcaacctgctactgtgatccgtccaaggcaaagaacgagcttggctgggaggcacagtatggtatccgtgagatgtgtgaggattcctggagatggcagaagaacaatccgaacggatatgaagattaagatgtgaagcagcggacggggctgccacacgatattgtattttaaatgggatacgttttgcgataagaaaaggagactatcgcgttccagatgcaatctgggacagcaattctaatcgtaaaatccggtatttctaaccatgccgcgtcgaacattctggatgatctgtgtttttccaagtttcggacattccacaaggtgtgttcgtaatccgcagacaattttaggacttttgtgtgtgccccttgttggcaccaatgaacaaaacataaccgcgcgaagccgatgtctgagctgccatctgccttattttcaatagcagatggcagtgagtttcggttcacgcggttttatattgtctgtgaagcggtgccactaggggcaccagaaagtccgctcattgtctgtggatttgccggacacaccttgtggaaagtccaaacatggaaagacacagaattcgatgtccaacgcggcatggaagaaatattcggattttcctccaaagaattgccgcctccggttgcatctggaacgcgatagtccctttttcttgtcataaaacgtatcccggtaagatgcaaagcatgacaactccgttttctggaaataaaaaaagaaagcgtaaacgctttcttcttcgggttgggctgttattactaacagtagcagttcctaggggaatcgaacccctgttttcgccgtgagagggcgacgtcttaaccgcttgaccaaggaaccatacggtataccaaatatattatgaaattgagcagttcctaggggaatcgaacccctgttttcgccgtgagagggcgacgtcttaaccgcttgaccaaggaaccgaacaaatgctattataacaggctttcaaaaaaaagcaaccccttttttgaaatttttttaaaaagctgaaaattctgtacaattcgtgaaaaaaggagtatgatggattgcgatagagtaacgtggtaaagtgcaggaaagtaaaagcagaaacgatacttcctgacgcagaaagagaggtttgtgcgatgtcgctggagagggcaaaggcatatttaaaagaatataagatggaagatcagatccgggagttccccgtctcctcggcaacggtggaactggcggcggaagcactgcacacggaagcagggcggattgcaaagactttgtcttttctggtggacggagaggcggtgctgatcgtgtgtgcgggagatgcccggattgacaatgcaaaatacaaggcatttttccgtgcgaaggcgaagatgcttgcgccggatgaggtggaggaacggatcggacatgcgatcggaggcgtctgcccgtttggaatcaaggaaggcgtgcgggtgtatctggacgagactttgaaaaaatatgagacggtttttccggcgtgtgggagcagcaacagcgcgattgaactgacgataccgcagttggagcagcttgcaaaaccggtgtgctgggtagatgtctgcaaactgccggcataaaagcctgtattttcgagaaaaagcttgcatttcccataaaaaagtgctactttaatatatgataacacgatgacttgattgagagaggacgaaagccctctctcaattcacgtttatgccctgtaaagtctgtgtaaaggccgggtgggcagtttgttacaattaaaattgaatatggagaaagaaggtgtacacatgtcaaagcgtgaaacatacgaagcgcgcaccgaagaactgattactccgatcttagagcgcatgcattttgaactcgtggatgtggagtatgtaaaagaaggcggaacctggtatctgagagcctacatcgacaaggagggcgggatcaccgtcaacgactgcgaggcagtggcgagagagatgaatgagattcttgaccgcgaggacttcgtggaagattcctacgtgttcgaggtaagttccccgggacttggcagaccgctcaagaaagaaaaagattatgtccggagcatgggaaaggagattgagatccgcacttaccgtgcaatcaaccgggaaaaggaattttatggtattttatctgcatatgatgaaagtactgtgacaatagagacagaaaacggagagaaaatgacgtttgagaagccggatatcgcgctgatccgtctggcattcgatttttgataaaatatatgctaataaccactaaggaaacaggaggataataaaatgagtagtaataatgagttattagaagcattgaatatactggaacgtgagaagaatatcagcaaggagacactgcttgaggcaatcgagaattcactggtgaccgcctgcaagaaccatttcggtacatccgagaatgtaaaggtgacgatggacccgcagacctgtgagtatcatgtgttccaggagaagaccgtagtagagcaggtggaggatccggtagagcagatcagccttgtcaatgccaagatggtggattccaaatacgagatcggagatatcgtgaatgtcgagatccagtccaaggagttcggacgcatcgcaacacagaatgccaagaatgtcatcttacagaagatccgtgaagaggagcgcaaggttttatacaaccagtattacagcatggaaaaggatgttgtgaccggtgtggtacagcgttacatcggaagaaatgtgagcgtcaaccttggcaaggtggatgcgatcctgaccgagaacgagcaggtgagaggcgaggtattccagccgaccgagcgcatcaaggtctatatcctggaggtgaaggatacgtccaagggaccgaagattctcgtgtcaagaacccatccggagctggtaaagcgcctgttcgagtctgaagtgaccgaggtgagagagggaatcgttgagattaaagcgatcgcgcgggaggcaggaagcagaaccaagattgccgtctggtccaatgatccggatgtggatccggtgggcgcatgtgtcggtatgaacggtgcgagagtcaatgcgatcgtcaacgaactgcgcggtgagaagattgacatcattacctggaatgagaatccggcaatgatgatcgagaacgcattgagcccggcaaaggttatttctgttatcgcggatgcggaggagaagtcggcgaaagtcatcgttccggattatcagctttccctggcgatcggcaaggaaggacagaatgcgagacttgcggcaagacttaccggctttaagatcgacatcaagagcgagacacaggccagagagtccggcgacttcatggattatgagagcgagtacgaggacgacgagtattacgaggatgacgagtacgcagaggacggcgaatataccgaagacggcgagtatgccggggacagatatgctgaggatgcggatgccgagggagaatacgctgaggaatccgaacttgcggatgagacagacacagagaatgaagaagagtaggcaggggttgatcagagaatggcaaacaaaaagattccaatgcgccagtgcgtggggtgcagagagcttaagccgaaaaaagatatgatccgggtaatcaagacggcggcggaagatgaggcctcctcacagattgtacttgatgctacggggcggaaaaacggcagaggcgcttatgtgtgtccgaacagtgagtgcctgcgcgcggcaataaaaaacaagggtctggaacgatcattaaaaatgccaattccaaaggaagtctatgatacactgacaaaggagatggagaagtttgaaaccagataaagtgttgtcgatgcttggcattgcagccaaggcgggcggtgtggcaagcggagagttttccacagaaaaagcggtgaaggatggcagggcatggcttgtcattgtcgcgtcggatgcgtctgagaatacacagaagcatttccgggatatgacgactttttatgaagttccgatgtatgtgtacggagaaaaagagacattgggacatttcattggaaaggaattccgtgcatcgcttgcagtgacaaacgaagggctggcccattcgatcgaagataaattgaaactgacgttaacaactgaataatggaggaaacaggatatatggcaaaaatgagagttcatgaacttgcaaaagagttaggaatagaaaacaaacagattattgaatttttaagtacgacggagcatgcggtaaagtcgcacagcagcagcattgaggatgatgtgcagaaaatggtgcgcgacaagttccagaaaaaggcagcaccaaagacggagacagcgccgaaggcggaggcagcgccgaagaaggaagcagcaccgaaggcggaagcggcaccgaaggcggaagcggcaccgaaggctgctgagaacgcggagggcagaccggagcgtccaaagaagaagtccagcattaccgcggtatttaatccgcagtacagcaagcagggaggcggacgccgcccgcagggagaccgtgaccgccgtccgatgaacggagaccgtcgtccgatgaatggagaccgccgcccacagggaggcagaccggagcagcgtcaggcaagaccggcaaacagctttgatgtcaagagagcatttgagcgcgcaatcaacccggaggctgcaaaggcagccgaggaggcagagcgtcaggcagcggagcgcgcaaaggcggccagaacggcagcgccggagaaaaagccgcaggagacagcagcaaagcagccggaacgccgtgaaaatgtatacgagaatgtgtatgagaacgtatatgcacagaatccgcaggcacgcccgcagggagaccgtgaccgccgtccgatgaacggggaccgtcgtccgcagggagaccgcgacagaagaccgggagcaaacggagaccgccgtccgatgaacggggatcgtcgcccgcagggagaccgcgacagaagaccgggacagaatggatacggcaaccgcggcggcaataatggcggaggaagaccgtacggcggaggaagacctggcgcaaacggtggtcagggagacagaaacggaggccgtggcggcaatggttaccgcggtggcaacccgtccggcagactggatcgtgagatcgaccgtatgaacaaggagaccgcagcatccacagaggaactgcgcggcaaggagtccagagagcgcgagaaagaccgcaacaagaacgacagacagagaaacgattatgatgcacttggcggcaagaagcaggagcgcttcgtaaatctggagaagaacggcggcaagaagaagccgaaccagcagccgcagccgaagcaggaagaggatgtgattaagacactcgttctgccggagaagctgacgatcaaagagcttgccgataagatgaaagtgcagccgtccgtgatcgtgaagaagcttttcatgaaaggcacgatggtaacggtgaaccaggaagtggactatgagacggcggaggagatcgcgcttgagttcaactgcatctgtgagccggaagagaagatcgatgtgatcgcagaactcttaaaagaagaagacgatccggaagagacacttgtggcacgtccgccggttgtctgcgtcatgggtcatgtcgatcatggtaagacatccctgctggatgcgatccgctccacccgtgtgacagacaaagaggcaggcggtatcacacagcatatcggtgcatctgttgtttcgatcaacggtcagaacatcacattcctggatacaccgggacatgaggcattcacggcaatgcgtatgcgtggagcaaattccacagatattgcgatcctggtagtcgctgcagatgacggtgtcatgccgcagacgattgaggcaatcaaccatgcgaaggcggcgggagttgagattatcgttgccatcaacaagattgataagccgagtgccaatatcgagcgcgtgaagcaggagctgtccgagtacgaactgattccggaagattggggcggaagcacggtattttgtccggtatctgcacatactaaggaaggtatcgagaaccttttggagatgatccttctgaccgcagaggtacttgagttaaaggcaaatccgaagcgtaatgcgagaggccttgtcattgaggctcgtctggataagggacgcggtgcagttgccaccgttctggtacagaagggtaccttaaaggttggtcagccgattgcatgcggaagctgctacggcaaagtgcgtgcaatgattgacgaccagggaagaagagtcaaggaagcgggaccgtccacaccggtggagattctcggactttcatcggtaccggaggcaggcgagacattcgttgccatggatacggagaaggaggcaagagcatttgccgagacctatatttccgaaggcaagaaccgtctgatcgaagataccaaggcgaagatgtcgctggatgatctgttctcgcagattcagtccggtaacgtcaaggaactggatattattgttaaggcagatgtacagggttctgtggaggctgtaaagcagagtctggagaagctgtccaacgaagaggtagtagtaaaagtaattcacggcggtgtcggtgccatcaacgagtccgatgtcagccttgcatccgcatccaatgcgatcatcatcggattcaacgttcgtccggacccgatggcgaagacaacagcggacaaggagaacgtcgatatgcgtctctacaaggtcatctacaatgcgatcgaggatgtagaggcggctatgaagggaatgctcgacccgatcttcgaggagaaggtgctcggtcatgcggaggtgcgccagatcttcaaggcatccggaatcggaaatatcgcaggttcctatgtgcttgacggtgtgttccagagaggctgcaaggttcgtatttcccgcgccggagagcagatcttcgagggtaatctggcatccttaaagcgtttcaaggacgatgtgaaggaagtaaaagccggatacgagtgcggccttgtctttgagggctttaatgacattgcagagcttgatatcgttgaggcatacacgatggtggaggtaccacgttaacaaacgttttgcgtgtatggaaggagctataaattgagaaaaaacagtattaaaaatacccggatcaacggggaagtgctgcgcgagttgtcgaatatcatccgcggggagatcaaggacccgcggatcaacccgatgaccagcgtggtcacggtggaggttgcaccggatctgaaaacctgcaaggcctatatcagcgtgctcggggatgaggaatcccagaaggcaacgctcgcaggtcttagaagtgcggagggttacatccgcaggcagcttgcccacagcatcaacctccggaatacgccggagatcacatttgtgctggatcagtccatcgagtacggtgtgcgcatgtccaagatgattgatgatgtgacaaaggatattccggatcggacggatgaggcagaagaggaaacagaagaatgacgaattttgatgattttctggcagaggttcatacggttgccatcggcggacacatccgtcccgatggcgactgtgtgggctcctgccttgctacttataattacattaaaacatggtatcccgacatcgacgtgacggtttatctggagccgattcccaatattttcaaatttatggcgcgctccaatgagatcgtctccgatttttccggggatacggtatacgatctgtttatcgcgcaggactgcggggatacgggacgtctgggcggtgcggcgcatttctttgagcaggcgaagcataccgtctgtgtggatcaccacatcagcaaccagagctttgcacaggacaactacattttcccgcaggcaagttccgcgtcggagcttgtctatgaactgcttccaaaggagcgcatcacaaaggagattgccgagtgcatttataccggaatggtacatgataccggcgtcttccagtattcgtgtacgtcgagaaagacgatggagatcgccggagcgctgatggagtgcgggatcaattatccgaagattgtggatgataccttctacacaaagacatacaaccagaaccgcattatggggcttgcactgttaaagagcaggctgcacctgaacggaaaatgtatttccagcgtgatcacggaggaggagatgacgcagtatgacgtgctgccaaagcatctggacggcattgtgaatcagctccgcgtgaccaaggatgtggaagtggcagtctttttgtatgagacgggagacggcacgtttaaggcgagcaccagatccagggaagtggtggatgtctcgaaggtggcggtaaagtacggcggtggcggacacatccgggcagccggattttccatgactggcgatgcggatgccatcatcgaacagattatttcggatctggcagaacagataaagtgagaaaaaagcagtatgatgaatggaattatcaatatctataaggaaaagggatttacctcgtttgacgtcgtggctaagcttcgggggatcttaaagaccagaaagatcggacacacgggaacgctggatccggatgcggagggggtgctcccggtgtgtatcggcaaggcgacgaagatctgcgaactgctgacggacaagacgaaggaatacgaggctgtcatgctgcttggaagaacgacggacacgcaggatgtgacgggcgagaccctgacgcagcaggaggtgcgctgcagtgcaaaggaagtggaaaaagcggttctctcgtttgtaggtgattatatgcaggtgccgccgatgtattctgccttaaaggttgacggcaggaagctgtgtgatctggcacgggccggcgtgaccgtggaacgtgcggcgcgtccggttcatattttttccatcgagatcctttcgatcgaactgccgcgtgtcaggatgcgtgtctgttgttccaagggaacgtatatccgcacgctctgccaggatgtgggggaggtgctcggctgcggtgcgtgcatggaatcgctgctccgcacgagagtcggagagttcgcgcttgcggacgccataaagctgtccgaggtggaggcgtacgtgattgcacacaggtcggatgcgacggagacagaagaactgcagcttccgttccttcaggcggtggataccgtctttctaaaatatgagagcgcgacggtggacggacagttccgcaaatatttatataacggaaaccggctgcgcccggagatgtttttggaggaacatgagagtatgagaatggcgccggtccgcgtctacgacgatgaaggcgcatttttcggcatttatgaatatcaggcggaaaaggaagactataaaccattaaaggtgtttaagtagatcatgaaatatatcaggaacacaacggatttttatatagaagagaatacggtactttctctcggcaagtttgacgggattcacagggggcatgagcagctgctgcagtattttgcaaagaaaaaggacgaaggtctcgcgggagcgatttttaccttcgacattccacctcgcagaaatgtgcagaatgtggaggcgaaggtgctgaccacgaatgaggaaaaaaggcacatgtttgagcacctggggattgattatgtggtggagtgcccgtttacgcaggagatcatgtgcatggagccggaggatttcatcgctaagattgtgcggcagcttcatgtaaagtgcatggttgtgggggaagactttcatttcggacataaccgcaggggcgattaccatatgctgcggcagtatgccggaaaatacggatacgaagtgatcgttgtggagaaaataaaagaagacagccgggacatcagcagcacgttcgtgagggaagagatcgcagccgggaatatcgagaaggcaaatcatcttctgggataccgttactttgtgaccagcagagtcctgcacggcaaccagatcggaagaacgatcgggattccgaccatcaaccagctgccgccgaaggagaagctgctgccgccgaacggtgtctacgtgacggaggcatacatcggagaccggtggtaccgcggcatcagcaacgtggggtgcaagcctacgattgagggagagtatcctgtcggggtggagacacatctgctggatttcgcggaagatgtctacgataagatggtgacggtggagttcttaagcagagtccgcagcgagcggaaatttgcatcgattgaggcgctcaaagagcagatgcagaacgatgttgcctatggccgtgcctattttgaaaaacacacctcgtaataattattacataaatgttacaaaaatatgttgacatcgtaaaaaatcgttgctatactggacgttagatttaaaaatgagcacaaactagaattgcgcaggagacggcgcaagaatggagagtcatatgaaagcacgattagcgagaatcgcaggtttggtcctggcgggaactctggtggtttccacagcggcaatagatcagaagtcaaagaatacagatgcggataccagtgcaaccgtggcgtccggtgttaccagcgcactgtccggaagtctcagtgacgcggcgatgggcgtggccggtgtttccggaatggacattgcaagaacggcacagggacaggaagcggttgaagagggcaccgaatcagcagaggcgggtgtggatgtggatgcatcgacgtcttctgccgctgccggagtatcggcagagcttgcagatgcagcagccgcggcctcacaggcgcaggacgaacttacagagacggagagcacagaggagcagacagagagtacagagcaggatgccgcacagcaggcggcgagcgcttacggatataccaatctcggtgtggcgaatgttgagggcaatctcaacgtccgtgcagcggcaggcactgatgcagatgtcgtgggcaagatgccgaacaacgcaggatgtgagatcctcggcgtggaaggcgaatggacacagattaagtccggttccgtggaaggttatgtaaagtcggagtatcttctgaccggagatgcggcgcttgccagagcggatgaggtaaagcagacgcttgccaccgtgacgacgacaaccctttacgtcagagagcagccgaacaccgactgcgcgattgtcacaatgatgccgcagggcgaggaactcgaggtgctcgaggtgcttgacggatgggtgaagatcaacgtcgacagtgatgagggatatgtctcttccgattatgtagagatctcgacagagcttttaaaggcgatgaccatgactgagatccggtatggacagggtgtttcggatgtgcgtgtatcgctggtgcagtatgcgacacagtttgtcggcaatccgtatgtatggggtggcacaagtctgaccagaggtgcggactgctccggttttgtcatgagcgtatttgccaactacggcatttcccttccgcattcttccggcgcgcagtcgaattgtggaacgaagatttcggcctctgaggcacagccgggagatctgttcttctacggaaacggaagccgcatcaaccacgtggcaatctacatcggcaacggacaggtggtacatgcaagttcaccgaagtccggcatcaagatttccggtgcctattaccgtacgccggtcaaagttgtgcgtgtgatcaataattaaaaagttgtttacaagcgtatgcagctatgctataatgcgagagtatgagttcagcccatattcggtaaatggacactccaaccttttactgagtatcatacacagtcgggcgatgggcccaaagggcccggtatggcagaagccatccaaacagaatattataaggaggatcagaacatgatcgcaaaggacaagaagcagaacattatcgcagagtatggaagaacaccgaatgacacaggttcaccggaggtacaggttgctcttttgacagcacgtatcgaggagcttaccgctcacttaaaggagaacccgaacgatcatcactccagaagaggtcttttaaagatggttggtcagagacgtggtttacttgcttacttaaagaaagtagatatcgagagatatcgtgctttaatcgagcgtttaggtctcagaaaataagatgtccaaagcgggcagacatgcccgcttatcaatagagcggagagcttccccgctctatttttactgtatggaggcacttccgtgcagcatggcaatctgacagaagcgtatccccgagaccactgaaatatagatacgtgcagtgtatgtatttcagtagtttcggtgcttctgcagagtgattttgcgggatccttccggcagaaccgaagaagagaatgaaagagaatcagaaaaggagaattcgcatgtacaaaagtttttcgatggaacttgcaggcagaacacttaccgttgatatcggaagagtctgcgcacaggcaaatggagcagctttattaaaatatggagagacgaccgtgctttctaccgtgacggcatcggacaagccgcgtgacggcattgatttcttcccgctttccgtagaatacgaggagaagatgtattcggttggcaagatcccgggaggattcaacaagagagagggtaaggcatccgagaatgcaatcttaacctcccgcgtgatcgaccgcccgatgcgtccgttattcccgaaggattaccgcaacgacgtgacgatcaacaacatggtaatgtctgtagatccggcatgccgtccggagatcgttgccatgattggttccgcactggttaccacaatttccgatatcccgtttgcaggtccgtgtgcaacgacgcagatgggtatggtggacggagagttcatcgtgaatccttcccagaaggagtgggacaagggtgatctgcagctgaccgtggcatccacagcagagaaggtgatcatgatcgaggcaggcgccaatgagatcccggaggacaagatgatcgaggcgatctacaagtgccatgatgtaaaccagacgatcatcgcgtttgtcaataagatcgtggaagaggttggcaagccgaagcatgagtatacaagctgcgcaattccggatgagatgtttgcggcaatcaaggaactggttcctccggcacagatggaggaggctgtattcacagacgagaagcagcagcgtgaggagaatatccgcgagattacggacaagctggcagaggctttcgcagacaatgaggagtggcttgctgttctgggcgaggcagtttaccagtatcagaagaagactgtccgcaagatgatcttaaaggatcataaacgtccggatggacgtgccatcaaccagatccgtccgctggcagcagaggtggatctgatcccgagagtacacggctctgcgatgtttacacgtggacagacacagatctgcgatgtggtgacacttgcaccgctctccgaggttcagaagatcgacggactggatgagaatattacgacgaagagatacatccatcagtacaatttcccggcatattcggtaggcgagaccaaggtatcccgcggaccgggacgccgtgagatcggtcacggtgcgctcgctgagaaggcacttatggcagtgcttccttccgaggaggaattcccgtatgccatccgtgcagtgtccgagacattcgagtcgaacggatctacttccatggcgtcgacctgtgcgtcctgcatgtccttaatggctgccggagtaccgctcaaggctatggtggcaggtatttcctgcggtcttgtgaccggagataccgatgacgattacattgttctgacagatatccagggtctcgaggacttcttcggagatatggacttcaaggtaaccggtacgcacaagggtatcaccgccatccagatggatatcaagattcatggtctgaccagaccgatcgtagaggaagccatcgcaagaacaagagaggcgagaatctacattatggatgaggtaatgtccaaggcaatcgcagagccgcgcaagcaggtgagcgagtatgcaccgaagattgtccagatccagattgatccggagaagatcggcgatgtggttggacagagaggcaagacgatcaatgagatcattgcccgcaccggcgtgaagatcgacatcacagatgacggttccgtatccgtatgcggtacggaagcggagatgatggataaggccatcgagatgatccggattatcacgaccgatttcaaggagggacagatccttaccggaacggtagtgagcatcaaggagttcggcgcattcttagagtttgcaccgggtaaagaaggcatggttcacatcagcaagatcgcaaaggagcgcatcaaccatgtggaggatgtactgacccttggcgataaggtgaaggtggtatgccttggcaaggataagatgggaagaatcagcttctccatcaaagatgttccggcggaagcataaagcagtcatgcaccggtaattgcataacagaaatgaagtgccttttctatggctttgcataagctataagaaaaggcattttttatgaatcgggtcagaaaaatcatccatacggattatgcatataaaacaggtttgagcgggaaaaatgtaaccgtggcgattatggataccggaattgttccgcatgtggatttcgggaacaggatccgatattttggagatttctgtgaaggaaagacgggactgtacgacgacaacggccacggcacacatgtgtccggaatcgtggcgggcagtggcgaggcatcgagaaaagaatacgggatgccggtttgccacggcattgcaccgcaggcggatatcgtgatgttaaaggtgctagacgccaaggggaacggaaataccagggatgttctggcgggaatggagtggattgcaaagaaccagcaggaatatcagatccgcctgttgaatatttccgttggaatgcttccaagcgcgggagagcgggaacagcaggaacttcttagcgcggtggacgatctctgggacagggggatcatggttgtcgcggcagccggaaataacggccctaaggaaaattcggtgaccattcccggaatctcaagaaagattgtaacgattggaagcagtgacgacggaaagagcgagccggggaagcgggggcttaagacggggtacagcagcaacggtccgacggcatgctgtattgtaaagccggaaatcctggctccgggcacggcgattaaaagctgcggcagggaaaaaaacggataccgggtaaagagcgggacttccatggcggcgccggttgtcacgggtgcactggcgcttgcatttcagaagtatccgtatctgtcgccggcggagatgaagctgcgcttgtacgagagagcgtatccgcggggagagcagcttggcagaaaatgctggggaatgattcatgtcgaccatctggtgagaggctgaagaggagcgggaggctgaagaaaatagaatgctgcaagacggaaaggaagggaagggaagggaagggaaggggaggtgacgtgaccggcggttgacattttatatgaaaaaacgtaagataaaaaatacggttttgaaagggaggagacttatgaagaagattgcacaccttctgatgggaagactgacaattgtcggggtttcgatattgctgcagatctgctggctgtttctggtgctgtggaaattcagctatcagtttacctatgcgaacctgataatccgcgctgcggcgattgttctggtgcttgtgattgcgaacaagtgggagaatccggcgaataaactttcctggacgtttctgattctgttgtcgccgatccttggaatcatgctgtatttcctgtttggacgctccggtctgacgaagcacaccagagaacagatggatgccgtgaaccgggaagtggatgcctgcatgccggtagacgaggaggcggtcaggctgctgcaggaggcggatccatcggttttacgacagtcaaaatatattgcggactggggacattttccggtctaccggaataccgccacaaagtattatgagagcggggaggcgatgttcccggatatgcttgcagcgttggagagcgcggaacactttatttttctggagtatttcatcatcgaggagggacatatgttccaccagatcgaggatatcctggagaaaaaggtcaaagagggcgtggaggtacgcctgatctacgatgatgtcggctgcatcggcacactgccgccgcggtattataagcagcttcagaaaaagggcatcaagtgcgctgcctttaatccgttccggccgctgctctcggtaatcatgaacaaccgggatcaccggaagatttttgtggtggacggcgcggtcggttttacgggcgggatcaatctggcagatgaatatatcaatgaggtaaaacggttcggctactggaaggacaccggcgtgcgcatcgagggcgaggcggtctggagtctgaccagcatgtttttgtccatgtggaattacatcgtccattccacggaagattacagccggtttatgccggcacagcatcagaaagcaccctttgagaatgacgggttcgtgcagccgtacggtgacagccctctggatcatgagaatgtgggcgaaaatatttacctgaatatcataaacagggcaaagaattacgtctatatcttcacaccgtatctgatcattgaccatgagatgctgacggcgctctgcaacgcggcgaaggacggtgtggacgtgcggattgtgacgccggggattccggacaagaagatgattttcctgctcacgcagtcctactatgcaccgctcatacaaagcggggtaaaaatttatcagtacacgccgggatttattcacgcaaaatgttttgtctgtgacgatgagatcgcaacggtgggcagcgtgaatcttgacttccgcagcctatatctgcatttcgagtgcggcgttttcttctaccgctccgcggttgtggcacaggtaaaggaagactgcctgaatacgtttgcgtgctcagagcagatgacggcagagttctgcagaaaccggccggtaccggtacggcttctgcagagtgtgctacgcctgctggcaccgctattataatagaaaaaagtcaggtcagaagatagaaaagcgccatcttgaaataatcgcggtatgaggcggcgtgaacatccgcagtgtaacggatattcacggagccgagttccctgccgcctgcggagtagacaaccctgccggccacgtcaccctttctgacaggtgccgtgaccgtctcggggagaatctgctctttttttacatcagagaggtcctcgccttttacagacaggtaggagaagggagagtcgtaggcgagaccgacggcggtttcggtgccctttgtcacaggaagatcgggcagagcgtccgtgttttcatccgtgtacaggcggcattttccgaatccgtaatttaaaagcgtggtggcatctgcaaagcgcactttgtaatcgggcgctgccatgacgacggcgatcagttccagaccgtctttttctgcggtggcagacacgcagtatttggcgagactggtggaaccggtctttaatccggtggcatactcatactgccggatgagtttgttggtgttggtcagaccgaattccgaacttccctttgccgtgacatgggtgatgttttccatccagatggtgcagtagttgtggatttcgggatggtttacggtgagttcgcgggacataagggcgacgtcgtaggcgcttgtcatgtgcccttccgtatcgagaccacagcagttgacaaaggtggtgtctttcatgccgagccctctggcacgctcgttcatctgacggacgaattcggattcggaaccgcagagatattccgccatggcgacgcaggcatcgttggcgctcgcaacgctgatacatttgatcatggtctctacggtctgggtctccccaggctctaagaacacctgtgagccgcccatgcttgcagcgtattccgacacggtcaccgtgtcggtcagggagatctgtccgcgctctatggcatcgaaaatgagaatcagggtcatgatttttgtgatacttgcgggatgccggatttcatgtgcgtttttttcgtagaccacagttccggtggacgcctccatcagaagaacgctcggcgccgagacggaaaggtcggcttcgctgttttccgccgcaagaacgggagaagagagagtgagggtgcagcataacagaaaagaaagaaactgcttcaaggtattctccaggattctttttgttactattgtagaggaagaacctgtacattatgcagcgtgcacaaaaagaaattggcatcccgcgggaaactctcatttgaaacactaattatagtagagaagattgtgcgaaaatactaaatataggaaaaaaccttgaatttttcgaggaaacaatgtaaaattgatacgttgaagatgtggcagagaggttctgccgccggagaggataagagaatcagatggaaatgaccgtaaaactgcaggtatttgagggacctttagatctgcttttacacttgctcgagaagaataaagtaaatatctatgatattccgattgtggagatcacgaatcagtatatggaatacatcgcagagatgaagcgtcaggatctgaatgtggtaagcgaatttcttgtcatggcggcgacactcattgacatcaaatcccgcatgcttcttccggctccggagacggaggacgaggaagaagaggatccgcgtgcggaactggtacagcagcttttggagtacaagatgtacaaatgtatggcatacgagctgcgtgaccgccagatggatgcggagcgtgtcctttttaaggagccgaccattccgccggaggtggcagagtatgaggagccggtcaacatggaggagctcgtctcggatgtaacgcttgccagattgaatgagatttttaagtccatcatgaaaaagcaggtggacaagattgatccgatccgttccaagttcggcaagattgagaaggaagaggtatcgctttcggacaagatggcatatctggagaattactgcctgacgcacagccggttcagtttccgcagtctccttgaggcacaggcgggcaagatggagatcattgtcacgtttctcgccattctggaactgatgaagacaggcaagatatttatatcacaggaacacacctttgatgatattctgattcagtcaaagattgtggcatagagttggagttttcgggatgaatgaaaagaattacgaggcgatcattgaggcgatcctctttacgatgggagaatcggtagagctggacaagatcgccgcagccatagaactggataaaaaagagacaaaagcgatcattgagaagatgatgaagcactacgagaatccgtccatcggtgtgaagattattgagctggacgatgcgtatcagatgtgcaccaaaagcgagatgtacgaatatctgatcaagattgcgagacagccaaagcgccatgtcctgacggatgttcttctggagacgctgtccatcatcgcctataagcagccgatcaccaaggtggagatcgagaagatccgcggtgtttcctgcgatcacgcggtgaacaagctggtggaatacaatctggtatgcgagcttggcagactggatgcaccggggcgcccgctgctcttcggaacgacggaagagttcctacgaagctttggggtacagtcaatcgacgaactcccggtattaaatccggtgcaggtggaggaatttaagcaggaggcggaagccgagatgcatatgaagcttgatatatagaacataaaagaaatcctggtgcaaatctgtgagagacggataataaggaattgccgcaacaagcatagaccgctttgggtgataagtaatattatcagaagaccacaccgtgggatttcagatggaaatgcaggtggaaattcggttcaaaaaatgtggcatttctaaccaaccggatgtttgcatcttcgatgatccgtgtctttccaagtttggagcactccgcgggtcatgtccgcatcccggaagacaatttgtaggacttttgtgtgtgtcccttatggcacctctaagcaaaacataaccgcgcgaagccgatgtctgagtcggcatctgccttattttcaatagcagatgccggcgagtttcggttcgcgcggttttatattgtctgcgaagaggtgcccttagggacaccagaaagtccgcccattgtctccggtgtgccggacatgcacccgtcggattgtccaaacgtggaagagacacggaatccgatgcaaacattcagccggaagaaatgctcacatttttctccaacgaatattccatctgcatttccacatgaaatccccaagtgtgtttctaataatattacttatcaaagcacgatatgcttattgcggcagttcctttttacataccgtttctgttctgcaaaaaatgagggacgcatatacatcagtgaagtcattttgggagaatggcatgtatcgacgctttctttctctattgttaagtatgagcttgcttattttttcgcctgtgcgtgtccgggcgcaggatgtgccggcagagtcggaactgtacgcaaaatctgccgttttgatggatgcggattccggaagaattctctatgagaaaaacgggcatgaagcgatggcgaatgcgagtacgacaaagattttaacctgtatcgtggcactggaaaactgtgatccggcgagcgtggttacggtgtcaaaaaatgcggcgtcccagccgaaggtacatctggggatgcacgagggacaacagttttatctgagggatcttttatatggtctgatgctggaatcctacaatgactgtgcggtggccatcgcggaatttgcggcgggggaggtgcagggatttgccgcgctgatgaatgcgaaggcagaggaactcggctgtgaggacagctactttattacaccgaacggactggatgcgaaggatgatgccgggtttcatcacacgacggcggcagaccttgctaagattatgaaatattgtattaaggaatcgttaaaaagcgacgaatttctcgagattacacggacggcgcagtattctttttctgatgcagaggggaaatgcacgtaccagtgcacgaaccacaatgcatttttgcagatgatggaaggggcgctttccggaaaaacgggatttaccggaaccgccggatactgctatgtcggagcgctgcagcgggaggacaaaacgctgatcgtggcgctgctcgcctgtggatggccgaacaacaagacctataagtggtccgacaccagaaaactcatgaattacggattggagcagttcaaaaagatcgacctgctgcagattgagccggacgaagcggagcttgcgcccatagaggtgcgggacggacagggcggaaaaatcggcgaaacggtgtatttaaaactggttgtcaggaactatgcaggggaggagagtatcctggcgccgctaagcagtgaggttacgcttaggtatgagattgcagaccggctgtatgcaccggtgaagagcggagattacatcgggaagattcgttatatgctgggggaggagacgcttgcggagcgatgtgtggtagccggggagacaatcggaaagatcgattatccgtggtgtctggggcaggtgcttcggcttctctggatcgaataaaaaacacaaacaaaaagcgtcaaaaaattaacaatttacttgaaatattgcagaaaagcaattataatttaacatagcgtaatttgttgaatttttatacaaagacgcatggatttacatcattcactatgaagccgcatcccaaatggatgtggacaacaatttatagatggagggcaaaaagaatgaatagtagcaatgatagcctggctatgcagcgcatcaccaggttagtcgacgagaacagtttcattgagatcggttctctcgtaaccgcaagaagcacagattttaatcttgcagcaacggatactccttccgacggagtcatcacaggacacggcctgattgacggcaatctggtgttcatttacagccaggacgcttctgttttaaacggaacaatcggcgagatgcatgcgaagaagatcgctgcagtgtatgacatggcgatgaagatgggagcaccggtgatcggctttatcgattgcgcgggagtccgtttacaggagtctgtagatgcgcttgacggcttcggactgatctatgcaaaagaagttgcagcatccggcgtggttccgcagatttcagccgtattcggcagctgcggcggtggactggcagtggtaccggcactttctgattttgcttttatcgaagaatccaaaggaaagatgtttgtgaattctccgaacgcaattgacggaaaccgcatcgagaagtgcgacacatcatctgcggcattccaggcagatgagaacggctgcatcgacgcgacgggaacagaggatgagatccttgcagacatccgtgagctggtcggcatgcttccgctcaacaacgagggagatgtctacacagacgagtgtgcggatgacctgaaccgtgcatgcgagagcatggatgccatgaagggtgatccgagatatcttctcagtgagatttcggacagccatacattcttcgagacaaaggcaggctatgccagagacatggtgaccggatttatcaagttaaacggtatgacggtcggcgcagttgcaaactgcacaacggtatacgacgaagagggcaaagagagcgagaagtttgacaatgttctttccgcaaagggatgtgagaaggcagcagagttcgtatctttctgcgacgcattcgagatcccggtactgactctgacaaatgtcaagggctacaaggcatgcaagtgctctgaaaagcgtcttgcaaaggcacttgctcatctgacctccgcatttgcgggagctacatgtccgaaggtgaacctgatcacgggagaggcatacggtaccgcttatgttgctatgaattccaagtctatcggtgcggatttcgtatatgcatggccggacgcaaaggtcggcatgatggatgcggatcttgcagtaaagatcatgtacgcggatgcatctgcggatgagcttgcagagaaggcaaaggaatatgatgcactgcagggcagcgttatgacagcagccagaagaggctatgtggatctgatcgttgatccggcagatacgagaaagtatctggtagatgcgtttgaactgttatacacaaagtgtgcatatacaccggacaagaaacatggaacaaaatagaaaggtgaagtttatgaagaaaaaattatctcttatactttgtctttgctttatggctctgggacttgcagcatgcggaacagatccgacaacggttgactatttcggaatgacttacgatgaactgcagagcagcatggaacaggaagtttccgcgctggttggtcttacggacgacaacagaacctatatccagtcctacggcagcgatacggcaatgaaacttgtcgagagctgggatgaggcgacaagtgatgtcggcgcatatcagggacttggagaattcaatatcacaaaggcacagaaaaccttaacagtagatcagtatgtagagtatcagaatcgtgaagtcatcgtttcttacatctatacatacaattacgagaccgagcagccggagcttactgatgcatccgcggacaaggtatacacgctgggtgagaagatggagaaggctgcgttaaataccctgatgggaatgggaaccgtattcgtggttctgatcctgatcagccttattatttactgtttccgctttatctctgtaatacagaacaaggcggccggcaagggcaagaagaacgaggcagaggcaggcgctgtggtagagcagatcggacagcgtgaagagcagcttaccgatgatcttgaacttgtggcagttatttccgcagcggttgcggcaagcaccggtgcatccgcggattctttcgttgtgagatcgatccgcagacgctaattcgtataaatgaaaagaaatcatattaggaggatatttcaatgaaaagctatacaattacagtaaacggcaatgtatatgatgtaaccgtagaagagaacggcgcagtgagcgcaccggcagcagcaccgagacgtgcagcagcaccggcggcagcacctgcagcaaagccggctgctgctgcaggcgcaggcagcgttaagatcgaggcaggcgcagcaggaaaggtattcaaacttgagaagtctgtcggtgatgccgttaagaagggagacagcatcatggttcttgagatcatgaagatggagactccggtcgttgcaacgcaggacggtacggtagcaagtatcaacgtaagtgttggagatatggtagaagcgggcgcattacttgcaacattaaactaatttaggaggaagacaatgagctattttagtgagacaatggggaacctcctgcatcagaccgctttctttaaccttacctggggaaattttgtgatgatcattgtcgcatgctttttcctgtatctggctattgcgaaggggtttgagccattgcttcttgttccgattgcattcggtatgctgcttgtaaatatctatccggatatttttgcagacccggagcagatgagcaatggtgtaggtggtttattccactacttttatgtgttagacgagtggtcaatcttaccgtctctgattttccttggagtcggtgctatgacagatttcggaccgctgatcgcaaacccgatcagtttcctgcttggagctgcagctcagttcggtattttcggagcgtacttccttgcaatcatgatgggctttaatgataaggcagcagctgctgtttccattatcggtggagccgacggaccgacctccattttccttgccggaaagttaggacagtcgggactgatgggaccgatcgctgtggcggcatattcctatatggcacttgtgccgatcatccagccgccaattatgaagctgtttacaaccaaaaaagagcgtgccattaagatggagaacttaagaccggtttccaagctggagaagattctcttcccgatcgtggttacggtggttgtatgtacgattcttccgacgacagcgccgctggttggtatgctgatgctcggtaacctgttccgcgagagcggtgtggtccgccagctgaccgataccgcatccaacgcattgatgtacatcgtagttatcctgctcggtacttccgtaggtgcatctacgagtgcggaggcattcttaaatacaacgacattaaagatcgttgcacttggactgattgcatttatgttcggtacagcagccggtgtcctgtttggtaagctgttatgcttcctcacaaagggcaagatcaatcctctgatcggatctgccggtgtatctgccgttcctatggcagcccgtgtatcccagaaagtcggtgcagaggaagacccgacgaacttcctgctgatgcatgcgatgggaccgaacgttgccggcgttatcggtactgcagtagcagccggtgtattcatggcaattttcggaatttagtgaaagagcaaatgccgtcatagacggatagcggtatcaaagtatccgctgataaggaggaaaaaatgtcagaagttgttaaaaaacctttaaaaataacagagacggtgctgcgtgatgcgcaccagtccctgattgcgacaagaatgacaaccgagcagatgcttccgatcgtagacaagatggataaggtcggatacaatgcggttgagtgctggggcggtgctaccttcgatgcatgccttcgtttcctgaaagaagatccgtgggatcgtctccgcaagttaagagacggatttaagaacaccaagcttcagatgctgtttcgtggacagaacatcttaggatatcgtccgtatgcggatgatgtggtagagtatttcgtacagaaatcgatcgcaaacggtattgatatcattcgtattttcgactgcttaaacgatgtccgcaacctgcagacagccgttaccgcatgtaacaaagagaaaggacatgcacaggtcgcattatcctatacacttggcgatgcctacactctggattactggatggagatggcgaagaaagtagaggatatgggtgctgattccttatgtatcaaggatatggcaggtcttttggttccgacgaaggcaaccgagctgattcaggcattaaagtctgcaaccaaccttccgatcgaactccatacacactatacttccggtgtcgcttccatgacatacatgaaggcggttgaggcaggctgtgacattatcgatacagcaatgtctccgttctccatgggaaccagccagccggcaaccgaggttatggtagaggcattcaagggcacagagttcgataccggtctggatcagaacctgttagctgagatcgctgactacttccgtccgatgcgtgaggaagcgttagagagcggtctgatgaacccgaaggttctcggcgttaacatcaagactctgttatatcaggtaccgggtggtatgttatccaaccttctgtctcagttaaaagagcagggcaaggaagacaagttcgaggaggttcttgcagaggttccgcgtgtgcgtaaagacctcggtgagccgccacttgttacaccgtcctcacagatcgttggtacacaggctgtgttcaacgtactgatgggagagcgctacaaagtggcaaccaaggagaccaaagacgtactgcttggaaagtacggtcagactgtaaaaccgttcaacccggagatcgtagacaaggtacttggcgaggagaagaagaacgccattacctgccgtccggcagatctgcttgagccggagctggataagatcgaggctgagatgaagcagtggaagcagcaggatgaggatgtactgtcctacgcactgttcccgcaggttgcaaccgaattcttcaagtaccgtgaggcacagcagaagaaggtcgatgcaagcgtcgcagataccaagaacggagcatatccggtataatcaaaaaacagttataacaaaaagcgggtgagcagtcacctgctttttttgctgccttttttgctattttatcacaccgcaggcaatccgttcgccggagtcgcccgcgggctgcgttgtaaagttatccggcatccggtgaatgatgagggattttccgataatttccggaatcgtaaaacgcttgtcataaaatgccatccaggcataaccctggttgcccagaagcggaggcatgtcgccgctgtgattcgggtgtttggccggcgtacggctgtaatgggcaccggcactggtaaacggggagacgcatacgccgttttcgtggatgtgcatgccgtaaaaattactggagccgggagccgcgacgttcggaagaccgaagacttcaacctccacgagagttccttcgtattctgtggcatagaaccgggcaagcccggagatggaaggaaaattgttgccgccggcaatccaggcggatgcatccggcggagactgcatcagtgtatgaataaaattggttgctggtgtgatatcgcgcatagctgcctcaatggaagagtgtcgttggtttattatatgcagcggcagaaaaatgcgctgcatgtaaggaaagttccatgcataatttcttgcaaaacaccatgtatttgatataataaaaacattgagcggatcacaattccgcagaagtgaggagaagcatgagcaatacaaatgacctgagtaaccgcatcaatgatgcttacagtaagctgagcaagggacagaaacggctggcaacctacattacggacaattatgacaaggcggtatttctgaccgccgcaaagctgggtgaggttgtgggcgtgagcgagtccacggtggtacgctttgcgacacatctgggatataagggctatccggaattccagagtgcgctggaggaactggtgcgcaataagctgaactccattcagcgcatggaggttacttacggcaggatcagccagtcgaagattctggagacggtgctgaaatccgacgcggacaagatccattccacactggaaaagattgatcagaatgcatttgaactcgcggttgacacgatcctgcacgccaaacatatctatatcatcggaatccggagctgtgcgccgcttgccagcttcatggctttttattttaccctaatgtttccgaacgttcatctgattcagacaagcagttcgagcgagatttttgaacagatggtgcgcatcggcaaggaggatgtgatcatcggaatcagttttccgcgttattccatgcgtactttaaaggcgatggaatttgcgaataaccggagcgcaaaggtaatcacactcaccgacagcgtacattccccgatgaacctctattcttcctgcaatctgattgcggacagcgatatggcttccattgtggattccctggttgccccgctgtcggtgatcaatgcgctgattgtggcgctctgcatgaaaaagcagaacgaggtggcgaaaacgcttgagatgttagaggatatctgggacgaataccaggtttacgagaacgatgagatcaattatatcgatgattccatcaagatgcggtatggaaaagtaggagatgcggaactgtatgagtaaggtgatcgtagtcggcggcgggccggcgggaatgtttgctgccattgcggcggcggagcggggacatgaggtcgttttgctcgagaaaaatgaaaagcttgggaaaaagctctacatcaccggcaaagggcggtgcaacatcacgaatgcgggggatatggacaccctgtttgccaatgtgatgacgaacccaaagtttttgtacagcgctttttacgattatgacaatcagagagtgattgatttttttgaggagaatggtctggcgacgaaggtagagcgcggcaaccgtgtattcccggtatcggatcattcttcggatgtgatcgccacgctacagcgggtactaaagcgcacgggtgttatggtgcagcttcatgcggaagtgcggcagatcctcaccggggaaggcgcggtgcgcggcgtgaagcttgccgacggaagcgttcttgaagcagagcgcgtgattcttgcaaccggaggattttcttatcagacgaccggttcgaccggagacggctaccgttttgcgagggaactcggacatacggtgacacagattacgccgtcactggttccgttctacgtgaaggagacctgcgcggcgaggatgcaggggctggcgctgaaaaatgtgcaggtgcgcatccgggacggaaaaaagctgttgtatgacgaattcggcgagatgctctttacccatttcggggtaagcggaccgctgattttaagcgccagtgcggcaatcaagccgggccgcgtggagaaggaactggcgatggagatcgacttaaagccggcactcacggaggaacagctggatgcgagacttctgcgtgaattcgaggaggcaaagaataagcagtttaaaaacgccgtcgtgcatctgttcccggcgaagatgattccggtgatgttagaagccggagcgattgatccggagaagaaggtcaacgagatcacgagagaggagcggatgggatttgtgcatctgatcaaggcgtttccgctgacgctctgcggtgtcagagatttcaatgaagcgatcatcacacgcgggggtgtcagcgtaaaggaagtgaacccttccacgatggaatcaaagcttgtgccgggattgtatttctgcggggaactattggatctggatgcgatgaccggcggatttaatctgcagattgcctggtcgaccgggcatctggcgggtgagagtatcgaatagaagaggagagaagaagagatgagtatgaatattgcgattgacggaccggcaggcgccgggaagagcacaattgcgaaaaaactggcgaaaaagctggcgtttgtctatgtggatacgggagcaatgtaccgtgcgatggcatactattttttacagaacggcattgcaccagatgatgagcaggcgattgcggcagcctgcccgaaggttgacgtgacgattgtgtatgagaacggcgaacagcaggtgctcttaaacggagagaatgtaaacggcgtcattcggacggaggaagtcggcaatatggcatcagcgaccagtgtctatccggttgtgcgcacaaagcttgtggaactgcagcggcagcttgcgacaaagacggacgtcatcatggacggaagggatatcggcacctgtgtgcttccggatgcgcaggtaaaaatatatctcacggcaagcgttgcaacgcgcgcaaagcgcagatatgatgaactgaccgccaagggaacccagtgcaatctggaagagatcgagaaagatattgaagaccgcgattaccgcgatatgcaccgggagacgtcgccgttaaagcaggccaaggatgcggtgttagtggacagctccgagatgaacatcgacgaagtggtggacgcaatctatcagatttatgcgagggtatagagaatatgaatgtaatcttggcaaagagcgcgggcttctgcttcggggtaaaacgtgccgtggatacggtatatgaacggattttggaaaaagaaccgctctacacgttcggaccgatcatccacaatgaagaagtggtgcgtgatctggaggaaaagggcgtcgtcgtggtaaacgatgtggacgaacttgcggggaagccgcaggggacggtaatcatccgggcacacggcgtggagagaggtgtctgcgagaaaatacagacgctcggcttttccatcgtggacgcgacctgcccgtttgtgttaaagattcaccggctggtggagcgctacagtggggaggactgtcacattgtgatcgtcgggaatgccagccacccggaggtgaaaggcatcaaaagctggtcgaatgcagaggatacgcgcgtgatcggaacccgcgaagaggccgaaaaatacgatgcttcccatgggaaaaaggtatgtattgtatcacaaacgacatttaattacaataaatttcaagaattagttgaaattataaaagaaaaaggttatgatataattgttttaaatacaatctgcaatgctacggaggaacgtcagacggaagcccgggcaatcgcggagcaggtggatgccatgattgtgatcggtggcaggaacagttccaacacgcagaagctatttgaaatatgtaaaaacgaatgcaaaaatacttactatatacaaactgtaaaggatcttgaccttgccgaagtcaggtctgtcgataacgtaggtattaccgcaggggcttctaccccaaacaatattattgaggaggttcaaaagaatgtcagaaatgagctttgaacaaatgctggaagaatcatttaaaacaataagaaatggagaggtagttgagggtaccgttatcgatgtgaaacctgatgagatcgttctgaatatcggctacaaggcagacggaatcattactcgtaatgaatacacaaacgaagcaaacgtagaccttaccacattggtatccgtcggcgacaccatggaagcaaaggttttaaaggtaaatgacggtgagggtcaggtattactgacatacaagcgtctggctgccgagaagggaagcaagagattagaggaagcatttgagaacaaggaagtgctgaccgctaaggttgcacaggtactggatggaggattatgcgtaaacgtagatgagacaagagtatttattccggcaagtcttgtatcagatacctacgagaaggatctttccaaatacaaggatcaggagatcgagttcgttatcagcgagttcaatccgaagagaagaagaatcatcggcgacagaaagcagcttctggttgctaagaagttagagcagcagaaagaactgttcgcaagaatcaagatcggtgatgtattagagggaacagttaagaatgtaacagatttcggtgcgtttattgatcttggcggagcagacggtctgcttcatatttccgagatgtcctggggcagagtagagagcccaaagaaggtattcaaggtaggcgatcaggttcgcgtattcatcaaagatatcaatgagaataagattgcactcagcatgaagttcccggcagagaatccgtggaacggcgcagcagagaagttcgcaatcggcaacgttgtaaagggcaaagttgcaagaatgacagacttcggcgcatttgttgagcttgcaccgggtgtggatgcactccttcatgtatcccagatttccaaggagcatgtagagaagccgtccgacgtattaaaagttggacaggagatcgaggcaaagatcgttgatttcaacgaggaagagaagaagatcagtttatctatgaaggcactgctcgcaccggaagaagatgcggatgcagatgttgcagatgtagatattgatgcggttgcaaaggaagaggagtaatctctgatttcgatgattgcagagttacagataggcttgcacgttggtggaagcctatttctgtatttgcatcctgtagataacaaagagagtcgagggataaaatatgctggaaacggacaattatgaaaagtttaaaaaggatattttagcgcttgcaaagattgatctgaattcttataaggaaaagcagatgcggcgcagaatcaacacgctgattacgaagaatcatattgcgacatatgatgagtatgtggcgctgatcaagaaggacaaagagaagtttgaacagtttatcaatttcctgaccatcaatgtgtcggagttttaccgcaatccggatcagtggaagattctggagaatgaggtgttcccgaagctgattcagaagtttggcaagaatctgaaaatctggagtgctgcctgctcgaccggagatgagccgtattcgctggtaatggcattgtccagacacctgccgcttgcaaacatcaaggtgattgcgaccgacattgacaagcaggtgatcgatacggcgcggatgggactctacaatgagaagagtatcgcgagtgtgccggatgatttgaagaagaagtattttaccaaggtcggcaattcgtatcagatctcggatgagatcaagaaacgtgtggaattcaaggagcatgatcttttaaaagatccgtatccaggcggatgcaatctgattgtgtgccggaacgttgtgatctattttaccgaggaggcaaaggacgagatttatgcgaagttttataaggcgcttgcaacaggcggcgtgcttttcatcggaagcacggagcagatcatgaattaccgggagatcggatttgagagagacaagtcctttttctttgagaaggcgtaaggttatatcagaggacgcatttttctataaagcaaaaaagcggcaggaaagaagctgtgcagtatatgccagattctttcctgccgtttttggtggtaattatatcagggctttctgccatgtgtttatttgcggtgggaacgcatggtttctaacagatgcagaacatagtccatctgcatagcgggatcggcggcaaagtccgcggataattcaaaatagcatttcctgccgcgcggctgttcacggaacaccggggaaaacatggcgtcatactgcggaagaaagatggcatattttttgccgtagcagttggaagcgttcgcctgcacgcggtgttctttgtcgacggcggatgcaatactcttgtgaactgcgatatcctccgcagggagatagtagtaatctttgggactgccgtcataaaagaagcgcagttctccctcgaagagacgtacacgcagccgggcggtacttccgctcatggagagataacagtcatcgtaggagaaggagaccggtttgggaacggggtactgcagcgccagtgtaaaaaacagctccttgttgccggaggcaccgtccatcgaccggtactcggacgcctggagtgactgcagagaaaatgcctgttcccagagttttgggtaggagaggacgggcagaagcttcggcatatagagaacgtcctcatagttgtgctgtttcagcagtgcaagggaatcctttgcgggatgccgcacgtactctttgtagacttcgatcagctcgccgccggagtaggcgtcgatgcggtcaatcccgagaaacagttcgatggatttctgcttgtagctggtcagggcaaacagaaatttgaaacgtgagacttccttataaagatcgatataactgtgcgcatcaaacggatcggaaaggtgcagcgccttgcatttcgccttcaggtatggaatgtcgaagccgataccgttgaacgtcagaatggtatcatagccggacaagagctccagaaaggcggaaaggacatttttctgatcggcggcgttctcggaaaagaactggtcgatgcacaaaagactgtcgcgccttgtggcgcagccgatcaggtagagatccgtgcgcgccggcgagaagccggttgtctcaatatcaaaaaaaatgcagttttctgtaaatacctcgttggaaacggggtctgaaaaatcaaaagtcagttcttcatgccaggttatcatctgaaaatcctctgtatgtaatattagggtaagagttccaattttgccgctgtgcaggtctggaaaggcatagatttcccggactcgcgggcgttcgcggcaaatagcaatgtacgctccggcaaaagcccggaaagcctgcggcttcccggactcgcgggcgttcgcggcaaatagcaatgtacgctccggcaaaagtccggaaagcctgcggcttcccggactcgcgggcgttcgccctatcaaaatcgtaccagccaaaatatacactgcaagcaggtaattttgccagatacgattttggcactgctcattgccttcgcgtacattataacataaatgtggaaaaaatattgtgaattctttgtcaataggttcgtgaaaaaatacaataaattgctacaatttccgagtgattgtgctataatctacacgagggtattctatgacttttggcatagaatataatatagataagagaaagtggggcacgagaaatgggttctaagacatttaaaggcggcgtccatccttatgaaggaaaggaactggcaaaggatcagccgatcgtagaagttctacctaagggtgatctggtatacccgttgtcacagcatatcggtgcaccggcgactccggtggtagcggttggtgacaaggtgctgaaaggacagaagatcgcagaggcaggtggctttgtgtcatccccgatctatgcgtcggcatccggtacagtaaaggcaatcgaaccgcaccgtgtggcagtcggtgacatggtgaattccatcgtcattgagaacgacggggcgtttgaagaggtggagtacacgccgtgtgaagacgtgacggctctctccaaggaggagattgtcaataaggtaaaagaggcaggcgttgtcggcatgggcggtgcaggtttcccgacacatgtgaagctgtctccgaaagagccggaaaagattgaatatgtaattgcaaactgcgcagagtgtgagccgtatctgacggcggactaccgcagaatgctcgaaaatccggaagagctgatcggtggaatgaagatcattctccagctgttcgatcatgcgaagggtgttctcggcatcgaggacaacaagccggattgtattgaaaagctgacagagcttgtcaaggatgaaccgagaattgaggtctgtcctttacagaccaagtacccgcagggtggtgagcgtcagctcatttatgcagtgacaggccgcgccatcaattccaagatgcttccggcagatgcaggatgtatcgtggataatgtggagaccatcattgctgtttaccgtgcggtaaagcttggcagaccggtaaccaatcgtatttctacgattacaggcgatgccattgccaacccgggcaacttcttatacagcatcggtaccagctatgcagaactggtggaggctgccggcggatttaagacacagccggagaagattatttccggtggtccgatgatgggatttgcaatgtttagcctggatattcccacgacaaagacatcttcctcactgctttgcttaagcaaggacgaagtgtccaaggtggagccgtccgcatgtatcaactgcggccgctgtgtggaagcatgcccggagcagctgattccgtcaagacttgccaagttttccaataacggtctggctgaggcgtttgaatcctggcacggactcgagtgcgtggagtgcggaagctgcagttttgtatgccctgcacgcagacagctcgcacagtccattaagacgatgaaaaagcaggtacttgctgcaaaacgcaaaaaataattcaaaaaacaagaagagagaggtggattatcgtgagtgatttatatcatgtttcatcatcaccacacgttcgtgccaaagataccacaagccgtattatgctgtatgtgattattgcattgcttccgacaagcctgttcggtatttacaatttcggatataaggcattggttctgattctggtaacgatcgcaagctgtgtggcatcagagtgggtatttaataagattgtacataaaaagcagacgatcgatgacctgagcgccgttgtaacgggactgcttctggcattgaaccttccggcaacccttccgtggtgggaggcggtaatcggcggtgtgtttgcaatcgtggttgtaaaatgtctgtttggcggactgggacagaatttcatgaacccggcgctgggcgcaagatgcttccttttgattgcatttgctgctgatatgacaaagttcggcatcacaaagaacggtattgaagtgtattccagcgtaacaccgcttgctgccatgcgtaacggtgaggcggtcaatacgatggatatgctgatcggacgcaccgcaggtaccattggtgagacatctgcgatcgctatcctgatcggagctattttcctgattctgatgggtgtgatcaaccttcgcatcccggcatcttacattattacatttgctgtattcatgcttttattcggcggtcatggatttgacggcagctatcttaccgcacagctttgcggcggcggtctgatgctcggcgcattcttcatggcaacggattatgtgacatccccgattacaccgatggggcagatcatctttggtatctgctgcggtatcctgaccggattgttccgctgcttcggcgcgaatgcagagggtgtttccttcgccatcatcttaagcaatatccttgtgccgcttattgagaagcacacggtgccgatggcattcggtcaggtgaaggaagcgaagaagcaggaaggaggcaaatagaaatgaacaagaagattgtacatgacgcattggttttatttgcttttactgttgtattaggtctgatcctcggcgtggtctacggcattaccaaaggcccgatcgaccaggtaaattatgagaagacacagtccgcttacaagcaggtatttgaggatgcggattcctttgaggagtacgctgatttcgacaccgctgcagcggaagatcttatggcgcagaatggatattctgacgatatcgaggctgtcaacacagcacttgacgcttccggcaatccgctcggctatgtgcttaccgtaacggcgaaggacggaagccagggcagcattacattctctgtcggcatccagaatgacggtacggtcaacggttattccatcacaagtatttccgagacaccgggacttggtatgaaagcacaggaagagccgttctacagccagtttgagggcaagaacgtagactcctttacggttgtgaagtcgacaccgtctgcggacaatgagatcgaggcaatttccggttccaccattacttccaaggcgatggcgaacggtgtgaatgcctgccttacatacttccacagcgtattagaaggaggtaactaatcaatgaacaagaatgtagaacgtttatataatggactcattaaggaaaatcctactttcgttctgatgcttggtatgtgtccgacacttgctgtcacatcctccgcaatcaacggacttggtatgggactttccacaacagtggtactggtactttccaatatgctgatttccgcattccgtaaggtgattccggacggtgtgcgtatgccggcatacattgttatcgttgcatcgctggtaacagtggtgcagtttatcatgcaggcgtataccccgagcctctccgagtcgctgggtgtgtatatcccgttaatcgttgtaaactgtattatcctcggccgtgctgagagctatgcttccaagaatccggtagttccgtctcttttcgatggacttggtatgggacttggatttacgatgggtcttaccctgatcggactgttccgtgagcttctgggcgcaggtcagatctttggtttccagattctgtccttaagctggttcacaccgatcaccatctttgttatggcaccgggagcattcctagtactggcatgtctggtagctgtgatgaagatcgtccgtgagaagatggcagccaagggcaagccgcttgccgagccgtccggatgtatcaccggagactgtgcaggatgcagtatgtctgctgcatgcaccggtaagaaaccggcagcggaaactccggcagaaaaagcagaataggaggatagatacggatgaaaacattacttttaattgcaatcggctctgccattgtcaataacgttgtattaagtcagttccttggtatctgtccgtttttaggcgtttccaagaaaacagagaccgctgccggaatgggtggcgcagttgtattcgttatcacgatctcttcgttcgtgacagcgctgatctacaaatatatccttgccaacagctatctgatgagcaagggcattgaccttacctacctgcagacgattgtatttattcttgtaattgctgcactggtacagttcgttgagatgttcttgaagaagtccatgccggcattataccagagccttggtgtataccttccgctgattacgacaaactgtgccgttctcggtgttgcactgacgaatgttaccaaggaatacggtattttggagagcgtggtaaacggttttgcaaccgcatttggtttcctgattgcgatcgttttaatggcaggtgtgcgtgagaagatcgagtacaatgatatcccgaagccgtttcagggtactgcaatcgtattgatttccgcatgtctgatgtcaatcgcattcatgggattctcaggaatgatttaggaggaaaaagaagatgaacgttacagcaattttatttgcagccttaatcgtgggcggcgtaggtatcttgattggatttttccttggtatttccggagaaaagttcaaggtagaggtagatgaaaaagaggaagcaatcttaggtgtgcttccgggaaataactgtggtggctgtggttatgccggttgttccggtctggcagcagcaatcgcaaagggcgaggctccggtcaatcagtgtccggtcggcggcgcgccggttgcagccaagatcggtgagatcatgggtgtggcagccgaggaaggcgagcgcaaggtagcatttgtaaagtgtgcgggaacctgtgagaaggcaggacgcgattacgagtataccggcaacgaggactgtgcagccatggcattcgtgccgaacggcggaccgaagtcctgtaattacggatgccttggatacggtagctgtgtaaaggcttgtccgtttgatgcgattcatatcgtggacggcattgcgcaggttgacaaggaagtatgtaaggcatgtggaaaatgtgttgctgcatgtccgaagcatctgatcgagcttgttccttacaaggcaaagcacattgtacagtgcagctccaaggataagggcaaggatgtcatgaaggcatgttccgttggatgtatcggatgtcatttgtgtgagaagaactgcccgaaggatgcagttcatgtcattgacaacgtggcatacattgatcaggagaagtgtgtcggatgcggtatttgtgcacagaagtgtccaaagaaaattattttgtaagaatcattttctccgaaaatcattctgtaagaatcgtttcttggaatgaaagtgtgaaataaaaacaggcgtgaagaattcgcggtaataagtacgaattcttcacgcctgttttgttgtttaatcttccagaatctcatagggaatgacggttcccatgccggagctggtgtgtacttcatagtcgtctgtgatgaaaatagcttccgtagcatcaaggctttcaacgagcgccataccgtcttccagcccgagggagaaacaggtggtggagagaccgtcgccgtccaccgatgcaccggtgatgatcgtgacctcaaggagcccgttatcgtaagggtaaccggtcgcggtgtccaggatatggtgataacgcgtcccatctacttcaaaatagcgttcgtagacgccggaggatacgacggtctgatcggtgatggagacggaggcaatcgcttcgttttcctcaccaaacggacgctgtatgccgatggtgtatgccgaaccgtccgtcttcgcgccgagcgcaagcacatttccgccgagattgatgtaaccggaagtaattcccttctggttcaggtaggctttcatctgatccgcgatatagcctttggcgatgccgcccagatcaatcctggcatcgggattttgcagagtcactgtgttgccgtcaatctgaatctcccggtaatccactgtggcaagagccgcctgaatgtccgtgtcggaggggatcatggagacatcggtctgatcaagcagcgctttggttgagatgtcccacagatcggaaagccgaccgatggtgatgtcgaatttgccgccgcttaagtcgccatatgagatgccggttttaagaagttcgatcgtctcgtcgtgtactgtcacgggagcgccgcccgcatcgttgattttggaaatatcgctgtctggaatcgtattggaaaaatatccctcgtacttttgcgcaagggcaaaacagtcatcgagcagttcctcgctccctttttcatagatcgagaccgagatgacagtgttaaaataaaatcctgacttggtaaccggttcgtccgccgtgcggctgcagccggagagcagcagatttgcagagagcaggggaaccagaagacaggagagtaccttcttttttctcatcataaaaatctccatttctgatgtttcccatccaatgtaccataaactttctgttcatacaatgtgaaaacatcaatttgccattttgatgaagatatgatagagtaatacagtatgagactctatgcccatttgggatgaatgattggaaaatgttacatataaaggggacgttagacagatggaacaaaagcattttcattttaatgagaaaaagagagttgtagtcaagatcggatcttcctcattgaattacggggagacaggcaatctgaattttaccaagctggagcatctggtaagagaactctgcaatctgcggaaccgcgggatggatgtgtgtctggtaagctccggcgcgattgccgtgggcagacagacgctcggcatggatgagcggccgaaggacatttcgacaaagcaggcatgcgcggcggtcggccaggcgcggctgatgatgatctatcagcggctttttgcggaatacaatcaggtggcagggcaggtgctgatgacgaagaacacgatggtgaaccctgtctcgagagagaatgcgaagaatacgttcgacgaattgttccgtcttggcgcaattccgattgtgaatgaaaatgatacggtttctacttatgagatgcagtttggcgacaacgacacgctctcggcaatcgtggcttctctgatcggggcggatcttttgatcctgctctcggatatcgatgggctttttaccgacgatccgcacaagaatccggatgcaaagctcattgaagtggtggaggagatggatgcgtcaatctacggcatggcgaaaagttcgaccggcagtgatgttggaaccggcggcatggcgaccaaactgacagccgcaaagattgcaacgctctcgggaacagacatgattattgcgaacggcagggatgtctgcattctgcatcatatatttgatgattcctttaagggaaccatttttcaggcaaagaagaaagaatctttccggattgaagattttattttggagacgatcggttaagaatacaggaaaaggagtactatgaaccaggaacagattgacagaatcaatgcgttatatcgcaagtcgaaggcggaagggttgacggaggaagaaaaaaaggagcaggcgctgctgcgcaagcagtatgttgcggatgtgaagaaaaatctggcggcgcagcttaacaatatcgatatggtgaatccggacggttccgtggagaaccttggagataagtatggaaaaaagacaggactttcctgacgcagcgctgacacaggagaaggcgcgtcagcagataagggcgcggcacaaagcatggcggatggaactgccgcaggaggaagtgcaggaaaagagcagaaagatctgtgagaggctggcggcgtctgactggtatcataacagcgctgtcatctacggctattatccgctcggcgcggaggctgactgtctgccgtttctggcacaggcactttcggacggcaagacggtggcgcttccggttacatcaaaagagcggttgcagcgggactgcggccaggtgaagagaatgcaggacacacaccggatggagttttaccggatcagagagctttccagggtgcgggagggcgcctttcatgtgatggagccggatgagagctgcaaacggatcgggggagaggatgcggtggtgctggtgcccggactggtctttgaccgtaaggggaaccggtacgggtatggcggcggttattatgaccgctattttgcaaggtttccgaagctgtcccgcatggcggtagcgtttgaagggcagatcgaggaacagcttgcggtgcttcccaccgacgtgcggatgcatcggatttatacggaggagcgggaatatcggatctgacagaaaggatggaaaggatatggaactgacagaactttgtaagagcgcaaaagaagtgagcagacagatcggcaatctggacacgaatacgaagaacgaggtgttgcgtgcagcggcagaggcaattgtggcacatactgaagagattatccgcgagaatgagaaggatctcgcccgcggcagagagaatcatatgcccgaaggactgctggaccgtctgatgctcaacccatcccggctggagcagatggcggagggactgcggcaggttgcagaactttctgatccgatcggcgaagtcctttccatgaagaagcgcccgaacggtcttatgatcggtaaaaagcgcgtcccgctcggtgtggtcgggatgatctatgaggcgagaccgaatgtgacggtggatgcgtttgcgctgtgttttaagacgggcaacgcagtgatcttaaaaggcggcagtgacgccatttcgtccaatatcgtcattgtttcggttctgcaggaagttttggaggcacatggcattccacgtgcggcagtatcgctgattgaagatacaagccgggagacggcggctgcgttcatgaagatgaacgaatatgtggatgtgctgattccgcgcggaggagcagggctgatccgcgccgtcgtcaatcaggcgacgattcctgtgattgagacgggaaccggcaactgtcatatctatgtggatgagagtgcggatttcgatatggcaatccgtattattttaaacgcaaagacccagcggatcggtgtgtgcaatgcctgtgaatcactcgtgatccatgagaaaatcgtggatgcatttatgccaaagcttgcggcggcactgcagcagaaggatgttgttatttatgcggatgagaaaagtcttgcagcggcagagcgccgggaggcggcaaatgacggagacctgaaaaaggaactgttgtcggcggcgacggaggaagactggggcagggagtatctcgattatatgatctccgtgaagacggtgtcgtccctcgacgaggcgatcgcacacatcaaccgctacaataccgggcattcggaggcaatcatcacagaaaactacacgaacgcgcagcggttcctggatgagatcgatgctgcctgcgtctatgtcaacgcatcgacgcgtttttcagacggatttgaatttggatttggcgcggagatcggcatcagtacccagaagcttcatgcaagaggaccgatgggactggatgcgctgaccagcacaaaatatattatatatggaaacgggcagacacgtccgtagatggtaaggatgaagatgaaaaagaaaatagacattgaaataatcgataaaaagcagatcccgcagagcgagccggagcgtcagtattactttatggacattgctaaaaattatgtggaacagctcgctgcaaaaaaaggcagtccgctgacctttcatgtcacgacgttcggctgccagatgaacgcgcgcgattctgagaagcttgtcggtatcttagagcgcatcggttatgtggagacggatacggaggaagcggattttgttatttacaatacctgcacggtgcgtgaaaatgcaaataacaaagtctacggaagactcggggtactccagaattataaaaagaaaaatccacatatgctgatcggactctgcggctgcatgatgcaggagacggtagttgttgaaaaattaaaagaaagctaccgctttgtggatctgatcttcggaacacataatatctacaaatttgcagagctgatcgtgacggcgatggaatcggattccatgacgattgatatctggaaggacacggaccagattgtggaggatctcccggtagagcggaagtattcgtttaaatctggcgtcaatatcatgttcggatgcaataatttctgcagctactgtatcgtgccgtatgtgcgcggaagggagcgcagcagggagccgaaagagatcatccgtgagatcgaacagctcgtggcggacggcgttgtcgaggtcatgctgctcggacagaatgtcaattcctacggcaagaatctgaaggagccggtgacgtttgcgcagcttttagaggaagtggagaagattgaggggttagagcgtatccgttttatgacctcccacccgaaggatctctcggacgagctgatcgaggtgatgggacgatccaaaaagatctgcaaacatctgcacctgccattacagtccgggagcagccggatcttaaagatcatgaaccgcagatatgataaggaacattatctggaactggtggacaagatccgcgcggcagtgccggacattgcgctgacgacggatattatcgtgggattcccgggggagacggaggaggacttcgaggagacgatggacgtggtgcgaaaagtgcgttatgacagcgcgttcacgtttatctattccaaacgtaccgggacaccggcggcatccatggaagagcaggtgccggaggatgtgatcaaggcgcgttttgaccgcctgcttaaggaagtgcagaagatctccgcagaaaaagcggaggcgctgaccggacagacgctgccggtgctgattgaagagcaaaacgagcaggatgcttcgcttgtgacgggaagactcagcaataactcggtggtacatctgccggggacagcggacatgatcggaaagattctggatgtaaagctgaccgagtgccggggcttttattaccttggcgagcgggcagacggaaatggtcagacggtatgaaaaagcgaatcagcagaaacgatgtgatttttcttgcaatactgcttgccgtggttacggtatttcttgtgatctatgagcggacgggaatgcgcgcggatgcgggtgcctgtgtgcgcgtcaccgtggacggcagcgtgtacgggacctatgcgctcggggaggagcaggagataccgattgtgcaggacggcgtgacaacgaatgtcctgacaatccgcgatggcagggcggacatgacggaggcggactgcccggacaagctgtgtgtccatcagaaggcaatctctaagaatcatgagatgattgtctgtctgccgaacaaagtggttgtggaggtgacgggaagtgaagaaaacggattcgactccattgcgagataaggtggcgtatctcggggtttttcttgcgcttgccttaatctgcagctatgtggaatccctgatcccgttttatttcggaataccgggggtaaagctggggctcaccaatattgtggtggtactgatgctgtactgtgtcggcactaaggaggcgtttgccatctcgatgctccggattgtactggcgggttttctgtttggcaatctgttcagtatcttatacagccttgccggcggaatgttcagctttctggtaatgtatcttttgaaacggaccggaaagctcggtgtgctgccggtcagcgtcgcgggcggaatgtcacacaacatcggtcagattgccgtggcggcgtttgtggtggagaatatcaacattttttactatctgccggtgcttttcgtggcaggcatcgttacgggactgctgatcggtgtggcagcccaggagatcatactaaggattggcggacggctgaaacgataaggaggaaatacgtgtgtacgcatatataaaaggcgtccttgcggatgtggaagaagagagcgtggttgtggaggcaggcggaatcggataccggatctatacgaccgggcagacgtttgactatcttccggctgtgggagaggaagtcaagctctatacgtatctgaatgtgcgcgaagatgcgatgattctgtacgggttcctgacgaaggatgacctgcgtgtcttcaagctgttaatcggcgtcaacggtatcggcccgaagggggcgctggcggtgctgtctgtgatgacaaccgatgatctgcgatttgcggtgcttggcgatgacgcgaaggcgatcgccaaagcgcccggaatcggtgcaaagacggcacagcgtgtgattttagaactgaaggacaagctgtcgcttgaggaggcgtttgaactcaaatccgagcatgtgagcagacagaacgagaacggaagcagcggtgtgaagaatgaggcggtgcaggcgcttgtggcgctcggctatgcctcttcggaagcgttaaaggcgttaaacggcattgagatcacggatgatatggatgtggaaacactgttaaaagccgcgcttaagaatatggcattcctgtagtaagggaagcggcaaggcggaagaaaggaaagctgggacatggagaagcgggtcatatccacgcaggtgcaggaggaagatcttaagatcgagaaaagtctccggccgcagacgctggacgattatatcggacagcagaaggcaaaggaaaatttaaaaatatatatcgaggcggcaaaggcgaggggggaatctctcgaccatgtgctgttctacggaccgcccggacttggaaagaccacgctcgccggaatcattgccaatgagatgggaacacatatgaaggtcacttcgggacctgccatcggaaaaccgggggaaatggcagcgatcctaagcaatctgcaggagggagatgtcctctttgtcgacgagatccaccggctgaaccgccaggtggaggaggtgctgtacccggcaatggaggattatgccattgatatcatgcttggcaagggagccacagcgcgctccatccgtctggatctgccgaagtttaccctggtgggagcgaccacgcgcgcgggacttttgtcggcaccgttaagagaccgttttggcgtggtgcatcatctggagttctacacggtggaggagttaaaaacgatcatcctgcattcggcattgacacttggggtggagatcgatgaggagggtgcttacgagatggcgagacgctcgcgcggaaccccgcgtctggcgaaccggctgttaaagcgcgtgcgcgatttcgcgcaggtaaaatacgacggccggatttcaaaggaggtagcgtcctttgcactggatctgctggaggttgacaagatggggctcgatcagaatgacaggaacattttgatgacgatgatcggaaaatttgcgggcggaccggtcgggctggacacgctggcggcagcaatcggtgaggatgccggaaccatcgaggacgtatatgaaccgtatctggtaaagaacgggctgatcaaccgcacgccgaagggacgggtggtgacagagctggcataccagcatctgggaatcgaacattccgtatagaaatagttgcttttccttaaatatgtcagtataatatactatatattgtagcggatacccgagtttggaggaaatggtatggcagagaagacaagcgccgaagtgatcatcggtggaaaggtatacacactgagcggttatgagggcgaggagtacctacagaaggttgccacctatatcaacaataagctgggcgagtttcagggcatggaagagttaagacatctatccggcgacatgaaggcgacgctgttgcagttaaatatcgcggatgattactttaaggcgaagacacaggtggagaagcttgagcgtgagatcgagcagaaggaaaaggaaatctacgatctcaaacatgatcttatttccaatcagatcaaggcagagagcgacgagaaagccagaaaagagctcgaggagcagaacaaggagcttttaatcaacaaggctaagctggaggcgagtctcgaggatgcgctgctcggcaaagtaccggaaaaagataaaacagaagaatagacaatacggggacgtaagagatttgctttcgtcccttattttcatataacaggtaagaaaaatgatgcagaaaagagaattggagctgctggctccggcgggatcatacgagacgtttgaggcggtcatacgggcgggggcggacgcggtatatctgggcggcagccattttggagcccgcgcatatgcgaataattttaatgaggaagaattgctgcgtgccatcgactatgcacatatccatggcagacaggtgtatctgacggtgaacaccctgttcaaggaggaggaactggaacagggactctatgagtatctgctgccgtattacgagcaggggctcgatgcggtgatcgtgcaggatatgggggcgtttgcaaggatacgaagcatgttccccgggatggatattcacaccagcacgcagatgactgtgaccggcgcggcgggtgcggcgtacatgaagcagctcggtgcgagccgggtggtcatggcgcgggagatgtcgtttgccgagataagagaaatccatgacaaggtgggaatcgagatcgagagttttgtgcacggtgcactgtgttactgttattccgggcaatgtctgctcagcagtatgctgggcggcagaagcggcaaccgtgggcgctgtgcacagccgtgccggcttccctatgaggtctacaaaaaggatcagaaatcccgtatcgcgtgcggcaattacgtgttaagcccgaaggatctgtgtacgattgatgccattcccgcacttgcagagagcggcatattctcctttaagattgagggacggatgaagcaggcggagtatgcggcaggcgttgtatccgtttaccggcagtatatggaccgttatctggaccggctgaatgaggagagagcgggcggctgcagcgaggatgaggcacgccggcgggcgaagaaggcttacgcggtaacggaggaggatcacagaaagctgctggcgctcggcaaccgcagcggttttaccgacgggtactatttccgcagaaatggcagggagatgattacctttgattccccgggacatgcgaagacagacgaggcactgcagaagacggtgcgggaacactatatcaaagtgcggccggagcaggaaatcaaagaaaaaatcaatggattcttaagattaaaaaaagatttatctgctacactgaaactgcaatgtgaagaatgtgagattacgtgtgagggggagcaggtattgcaggcgcagaaacagccgctctcgcgtgacagggtggacgtctgtatgagaaaaacaggaaatacaccgtttgcatttgaacagctggccattgagatggacgaggatgtttttctgccggtgcaggcactaaacgcgctgcgtagggaggcacttcttgcactggaggagaagcttctgcagggataccgcagggatggagcagcgtccccggaggcggagaagttaggctgtggcgcggacaaaaggacgcggcaggaggagcgaagagaagcagaggatgccggtaaaacggtcatcgtttcgttggagaaccggtgtctgctgccggtggtgcttcgttcttcctttgtacatgggatttatgtggacagcagctgctataccagggatgaattatggacggcacttttaaaagatgcaggagaggcacacctggcgggaaagaaattctattatattctgccggcggtatttcgcagcagaacggcagcattttacagggagaatatagagcacttaaaggcattgccgctggacggatttgtggcaaaaagttacgatgccgccgcatttgtgcggcaggagctgggtgcggagacgccgttaattttagatcacagtctctatagctggaacagtgcagcgcgggatgtgtttttgcagcttgcaccagagcgcgataccgtaccgcttgaactcaaccggagcgaactgtttgcgagagacaatcatcacagcgaggcgatggtgtacggttatcttccactgatgacatccgcgcagtgcgtgcatgcgaacacggagaagtgtgataggaagcgcggaatcttatatctgaaggatcggtatggaaaatatttcccggtcaaaaataactgcacggagtgttataatacgatctataataccacgccgctcatgctttttgacgaacgcgcggattttttacgcatgggaattgccgcataccggatatcgtttacgattgaggaggaagagcaggcagctttcatactggatctttttgagcggacgttcctttccggaaaacacagcgtaaaggaactgtttcccgacggctacacgaggggacattataaacgaggggtcgaataaccaatgacagatttgattgtagaattatcaaaatatctcatgacacttttgttcgcgttctatacgtacgagtgtttttcctcattccgcgggaagcttaccccggagaaaagggcgaagatatttaagcgtcagatgtgcctgatgtatctcattcatctggatgcgtttctggcaatctacgcggtgacggacgatatccgcatgattttgttctatgtggtgcaggcggcgtttattgccgtcacaatttccagttaccgcctggtgtacggaagggcttccgggcttttgatcaacaatatgtgcatgctgttaatgatcgggtttattatgattacaaggctttcctttgacaaggcgatccggcagtttgccattgcggtgggggcgatggtgtgttcgctcattataccggtgctgattcagaaagtgcgctttttgcggaaaatgccgtggctttacgcagctgccgggatcatcggtcttctggcggttctggcgttcggaatcacgagcagcggtgcgaaaatatcaatctcgcttgccggaatatcggttcagccgagtgaatttgtcaagatcatatttgtattttttgtggcatgtatgctttacgagaatacggatttgaagcacgtgtgcatcgcgacggtgctggcagcggtgcatgtcctgattctggtgttatcgagagatctgggaggagcactgatcttctttgtgacctacctggtgatgctctatgtggcgaccagaaagctgttctattttgcgggaggacttctgaccggatgtattgccgcggtggtggcatatcagctgttttcccacgtgcgcgtgcgtgtcctggcatggcaggatccgctctcaagaattgagaatgagggctaccagatctgccagtccctgttcgccatcggtaccggcggctggtttggaatgggactataccaggggatgccggaaaagattccggtggtcgagcaggactttatcttttccgccattgcggaggagatgggcggcatttttgcaatctgtcttttgatggtgtgcatcagctgctttttgatgttttttaacgtggcgatgcagatgaaggagcagttttacaagctgattgcgctgggactgggaaccgtatacggatttcaggtgttcctcaccgtcgggggagtcacaaaatttattccgtcgacaggagtcacgcttccgcttgtcagctacggaggaagctcgctattttcaacgatgatcatgtttgccgttgtgcagggcttatacatcagacggcaggatgagggggcagcaaatgaaagaaaaaatgcagcaccgccaagacgaagaaaaacaggatttgacgaagatgtggaaactttttcataaaaacggaaagaaaaaaaagaatacaaaaaaccgggaatttgcggtagtaacctactcttttctggggttgtttctgtgcctgatgggctattttgtgtattttgagcaggtggagagcgaacagtttatcaataatccgtacaacaaacggcaggagctctttacgcgcagcgtcgtgcgcggcagtatctattccgccgacggagtcacactggcggagacggttacggatgcagagggaaatgagacgagaaagtatccggcgggcaggatctttgcgcatgttgtcggatattccacacacggtacttccggcattgaggcgatggcgaatttcaatctgctgcgctccaacattctgtatatggagaaggcggtcagtgagatcaggggagagaaaaatccgggggacagtgtcacaacgacgttgaattatgatctgcagcttcaggcgtacgatgcactgggaagctatgacggggcggtcgttgtgatggagccggagacaggcaggatccttgccatggtgtcaaagcccgattttgatccgaacacgatcgcggatgactgggatacctttgtgtcggacgacagtgacagctcggttcttctaaaccgtgccacccaggggctgtatccgccgggatcgacgtttaagatctttaccacgctcgagtacattcatgagaatgcggactatgcggactatcattttgactgtagcggcgagtataccgtgggcacaaagaccatccactgccataacaataagcggcacggatcggaggatttaaagacctccttcgcaaattcgtgtaattcctcctatgcgtccttaggactcacactggatctggaacagtttgatgatctctgtgaccagatgctgtttaataccgcgcttccgacggatttcgagtcgtcgaagagcagctttgtgctggagccgggagacagcgattcagcggtgatggagacgtccatcggacagggtaagacgcttgtgacaccgtttcacatggcgttaatcgcttctgcgatcgccaacgacggtgtgctgatgaagccgtatgtgattgaccgcatcacggatgcggagggcgaggttgtggagcagtatgagcctgcggagtacaaaacactgctctcggagagcgatgcgtccgttttgcaggaatatatgcgctatgttgtggaggaaggaacagcgaccaagttaaagagcgacagctatgaggcagccggaaagacgggttcggcggagttctcatccagctcggacgccacacattcctggtttgtgggatatgcgcataacggggaggaaccggacatcgcggtggcggtgatcgtggagaattccggcgtgggaagcgagtatgcggtcccgattgcaaaacagatctttgatgcgtattatacatgggagaactaagcgcatacgaggttgcgtgaagtctgaaaaagtattatactggatataattatgaaaagaccacatcgggaggtattgcaatgatagaggcaacaagctgtggcggtgtggtaatattccgtggtaagatattgcttttatacaagaattataagaacaagtatgaaggctgggttctgcccaaggggacggtggaagccggggaggagtatccggatacggcaacgcgtgaggtgttggaggagaccggggtgaaggcggcaattatcaaatatgtcggcaagagccagtattcctttacggtaccggaggacacggtggagaaggacgtccactggtatcttatgatggcagacagttattacagcaagccgcagcgggaagaatattttgttgattccggatattataagtatcacgaagcgtatcatctcttgaagtttccgaacgaaaaacagattctggagaaagcttacaatgaatatctggagcttaagaagagtaatttgtggggaaatcacaaatacttttagagcagtgtgatatggagagcatgcatgacatggtatgacgagttatatgtaggggaaagtattgtacataagacaaagcgcgtgaagtggaaaatcaaccacaatgcgggacagatcggcatttatgtgatcgcgcctgcgtcgaatgacaaaaatcttctggatattatcccggctgccgaacttttgcagaaagggtatccgaagaaagaccttaagattgccggacttgccgggagttatgatgaggcgctggaagtggcggtgtcgattgtggatgaagtataccggaacacaggagcgttttttgtgcgcagttatctggatgagcaccggagcggcagggagggataatggcagttctattgctgatattaaaaataattggaatcatcctgctgatcctgcttggactgatcctgctcattttggcagtggtgctttttgttccggtgcggtatcaggtgagcggcagcatcggggagaagacgaccgtccggattgcggtgtcatggcttttgcatgcggtaagctggagggcagcgtacgaagaggaagggttttcttcacagctgcggatctttgggatcacccggaaaggaaaaaagccggacgatggagaacccggggaggatgaccgggaggacggtgcagaagaacccgaagagcgcagtgcggcagatgcccccctggcagacagtgagcagaaaacagaaggcatcttggcagacggggagcagggagaggcggaacggttcgacgagaggcaggcgaagaaagtctgcgccggggcgaaggagccggatcctgcggagcataaggaactggaacaagcgaatccggctgtgcgcagaaagcagcgcggcgggctgtttcggcggatatgggagcgtatccgtgcattctttgcaggacttgtcagaaaactgcggcagtttcgtgccggcataaaagaggctcttaagaaaataaaagatgtccgtacgtttttgacggacgagcggcacagagaggcgctgccgctcatttttacagagttaaaatacctgctgacccattttaaattccggaggatccggacggatctgacattttccatgggggatccggcgctgaccgggcaggtgctcggaggcttatgtatgcttccgtttctgtatcggtatcaggtgcaggtatatccggactttgaagcggagaatacctatgtaacaggcacatttgatataaaagggcgtgcaagaggactgcatatcgcagtatcggcagtccggctgcttggcaaaaaggagttccgcatctggctgaaatggctgatgcacagataaaggataagaaaggggtaacattatggcagataacagttttcacacaacagtagaatccctgtttaagggaatggacagttttattacgacgaagacggtggtgggcgatgcgattcatatcggggataccatcattcttccgctcgtggatgtatcatttggagttgccgcaggagcattttcacaggataagaagaacaacggagcaggcggtatgggcggcaagattatgccgagcgctgtgctggtgatccagaacggtaccacgaagctcgtgaacatcaagaaccaggacggcgtcacaaagattctggatatggtgccggattttgtgaacaaatttacctccaggaatcaggtcgcagccgatacagcgtccgctgcagacgaggatgagacgaaggcgagagaagcggctggcaaagagatggaggacatcttaaaggattccgtgaacaaagaagaaaactaaaaaacagtagagaaacttccggcagatgcatatgatgaagagacagattgtttgggggatcttatgaagcggatgatgggatttgcactgttttgcttttccatggggatgctggtgatgctcgtgctccacagccgtttctttgggttccttcttctggtattatgcatgatcgccggttactatctgttctgctgtgatgactgagagcacacggcagaggagagggaagacggaaaaaatatttatgcaaactttatattcgttggagaaaaatgtgagcatttcttccaactgaatgtttgcatcaaattccgtgtctcttccacgtttggacactcacggagtgtgtccgacaagccgcagacaatgagcggactttctggtgtccctaatggcacctcttcatagacaatataaaaccgcgcgaaccgaaactcgccggcatctgctattgaaaatagggcagatgccgactcaaacatcggcttcgcgcggttatgttttattcgacaacagatggcatttatgccatctgttgtctggtgccgcaagggacacacacaaaagtcctaaaattgtctgctggcttgcggacacagtccgtggagtgctccaaacttggaaagacacggatcatcgaagatgcaaacattcggttggttagaaattccacattttttgaaccgaatttccatctccatttccacatgaaatctccaagtgtgtttcatataatattacttatcactccaaagagatccatgcttattgcggcaattacttagttggaacggcttatgcgagcaattcctttacgcatgcagcaatggcgtcgtccttgcagtttgcatagaaatattcggcaaaatgttcgccgctcaatgcaccgacgacgagatcacggtcaagctcttttaagatggagacgagatcgcggtgtgtgacttttttcacctcatcgaggattttcttgttgcgctgctccggcacgacacgctccttcggataaccgccaccgcccggtgcacagaataatttctcgaagatgtatgtgaggtttagctcgccgccccagccgaagttctctgcgaacgggagagcaatacagttgccgtcattgacctgtgagaagagataagcatccagaggagactctacatgtccgcagagtacctgcgggaaggaattgcaggcaagcatagcaccctcgccggtaccgcatcctgtgatgacgaaatcggctgcaccggaattcaataatacagcggcaagaataccgttctggacataggtgagcggatgctcatcctcggcagagtacataccgtaattgaatacggtgtgacccgtcggctctacaacggactttaatgtgttgcagatcatttcattcttggctgcctggctgttttcgttgattaaagcgattttcataatggtttagacctccgttttataacaaatctgtcatggctacgtcgtccatgtcgtcaaaatcctgattctcaccgaccatgccccagataaaggtgtaagcctgggtgccgcatccggagtggatcgaccagctcggggagatgactgcctgctcgttgcgcattacaatgtggcgtgtctctgtcggctcacccatgtagtgcatgacaagggcatcttctggcatatcgaaatacagatagacctccatgcgtctgtcgtgtgtatggcaaggcattgtgttccatacgcttcccggctcaagttttgtcatgcccatttccagctggcagctctctacctgaccaggaaggatatatttgcagatcgttctgtggtttgctgtctccagggaaccgagttctactttgttgcagtccttgacgatgacaacaccatcttccggtgtgccttccggcttgatgagaacggttggacatgtgcggtgtgcaggagcactgtttaaatagaattttgccggtgcagcggcgtcatcgcttgcaaaagtaatgtcgcgggagcccatgccgatatacatgccttccttgtgtgcaacgtggtaagcctttccatcgatggtgatggtgcctgcgccgccgatattgatgacgccaagctcacggcgctcacagaaatactgtgcgcggagttcgtcgccggcggtcagctttaaggtctcttttaccggaacggcagaaccggtaatgatacggtcgatatggctgtataccagtttgatgacatccggcaaaaacaggtcgtcaatcagaaattcctctcttaaacgttcggtggtgtagtgtttgacatctcttggagatgcagctgttctaagttccatgataaaatatcctttctatgtattgttgcatgaaatgcccggaaaaccgggcatttcaatgggaaaccaattagcaggtctttaagtcaaatccgaagtagttgacggcattgttgtagcagattcccttcacgatctcctcaagtgtctcgtagtctgccgggaactcgccgttctctacccagttgccgatcagattgcagagaattctgcggaagtaatcgtgacgggtataggataagaagcttctggagtctgtcagcattcccacgaatccggaaaggtttccaaggttggcgagagagatcatctgatcctgcatgcctgtcttgtgatcgttgaaccaccatgcggaaccctgctgaatctttgcaactgcggtggaatcctggaagcagccgaggatcgtgccgatggcctggttgtcgttcgggttcaagctgtagatgatcgttttcggaagttcgtcactctgatttaaggcatttaagaaatctgccatctcagaagaaggagcgtagttgttgatacagtcatatccagtatccggtccgagcttgttgaacatcggtgtgttgttgtcgcgcttgcagccgtagtgcagctgcattacccagttgcgctttgcatactctttgccgacattgaccatgaatgccgtcttgaactttaattcttcttccttggtgacatcatttcctgcaagacgttttgcgaagatgctctcgatctcttctgcggaagcaggagcgtacattacatactctaacgcgtggtcggagacacagcatcccatggaagcgaagaaatccatgcggttggaaagtgccttgcacagatccgcgaaggtggcaaccttgatgccggatacagcggataactgatccaggtactccggataggtcggtttttcaatgttcattgccttgtccgggcgccatgcaggaagaacctttacgtcgaaagaagcatcctcggcgatcttcttgtgccactccagagaatcgatcggatcatcggtggtgcagatcagtgtgacgttggactgcttgatgatgttgcggacagtcatatccggctcagcgagacgcttgttgcagagctcccatacttcctcagcggtgtttttgttgagcacgccgtgatagccgaaatatttctgcagctccaaatggctccagtggaagagtggattgccgatagctttgccgagtacctcagcccactttaagaatttctccttgtcggaagcgtcgcctgtaatgaagcgctcgtccacgccgcaggaacgcatgaagcgccatttataatggtcgccgccgagccatacctgtgtgatattttcgaactgacggtcctcataaatctcctgcgggttgatgtggcagtggtaatccagaatcggtgtggctgccgcataatcgttgtacagcttttgggctgtctctgtctgcagtaaaaagtctttgtccataaatgttttcatctttttttcctccataagttgttcttggtatatttgaaaaccttaaaataatgtagtgcctcgtttgataagtttgccggaaaaaatggatttcttcggcatttcctcaccctggagaactccgagcagagtctgcaccagctgatgcgtctgtgtctcaagacggttgtcaacggaggtaagctccggtgtacagcaggtggtgagcatggaattattatatccaattaccgacaaatcttccggtacgcaaagtccctgacgtctggcgtatttcatggcgcctatggcaagcggatcctccgatgcgatcacgccgtgaaaactcagcttctttttggaaagacgttccagataattggcgacgtcgtccatctgctgcgggtctccctcgtagaagagaatccgtttctcgtaatccgggacagagtgtgcctccatggcggcgcgaaaaccgcccagctttttgacgccgctgtaggaattggaattgtacagatagagaatgtcctcaatccccgcgtcaagcatggaaacggttgcctcgaacatagatgtgtaatcgtcgcagagtgtgctgtacacattcggatagtcaaaggaagcgttgagcagcataatgggaacctgtgcggaaacgtccttgatgtactggttctcctcctcattggtaccgatgaagttggaaccaacgagaataatgccatccactttcttggaaagaatgaggtttaagtaattcttcttgatgtccagattgtaaccggtacagcataaaagggattcatagccgttggactgaagctcctgctcgagataatacactgccttggcgagaaaaagatccgaggaatcggcacagagaataccgatcgtctgtacggaatgaagtcccatgccgcgcgcaaatgcattcggagtatagtcgtatttttctataatatccattaccttttttcgggtagctggccggactttatcgcttccgtttagaacacgggagacggtggcaatggaaacaccggctttcttcgaaatgtcgtaaattgtcatggtgtgattccttttgaaactccttaatatggaagaaatgagatgcttcccagggcgttacatgtaaagttacataatgtaaggtacaaaacaagtatagctgtgaaagcagtttcattgcaaccacatttattatacaatattgaaattgagaaagcaacaacagaaacaggaaaaaataacaaaaatgccaaaagaatgaaaaaaaagtaatggaatatagataacatcactaaattgtgcaaaattacatattgactaatcctataaaaggtgtaagaatacatggtgtaaacgcttacaaagtaacaaaatgcagtatatatcagaataccaggaggatatcatggacttattaagcagagaaaaaacaggaaaggttgaaagacctgtcagagtattacagtttggagagggaaatttccttcgtgcttttgtggattatatgattgatatagcgaacgagcagggcagattcaatggcgatatcgtgttggtaaagccgatcgagttcggaagcctggatcgtttccacgagcaggaatgtcagtataccgtacagctgcgcggaattgtagatggagaaccgaagcgcattaaccgtattgtgaccagtgtggcagatgcggtagatgcatatggcgaatatgaaaagtatgcggcatttgcaaaactggatacactccgttatatcgtatctaatacaacagaggcaggaatcgtgtatgacgataccgaccgcctggagatgaacccgccgaagagttatccgggaaaattaaccaagttcttatatgagagatacaagcactttgacggtgcggctgacaagggtcttgtgatgctgccggtagagctcatcgatgacaatggtattcatttaaaagagtgcgtattaaagcttgcaaaactctggaacctggaggaagaatttactgcatggctgaatgatgcatgtgtatttacctccacactggttgaccgtatcgttaccggatatccgagagacgaggcggaggagctgtgcaaagagttcggctaccaggacaacttaatcgtaacgggcgagccgtttgcactctgggtaatcgagagtgcaaaggacatcagcaaagagttcccgcttccggatgcaggacttccagtgatctttacagacaaccagaagccgtataaacagagaaaggtcagaattttaaacggagcgcacacatcctttgtacttgcgtcctatctgtgcggcaacgacatcgtattagagtccatgcaggatgaactgatttttaacttcatgaaagcaaccattttcgatgaagtaattccgacgctgacacttccgaagcaggatctgatcgatttcgcagaggcggtaatcacaagattcaacaatccgtatgtaaagcacgcactgttatccatctccctgaactctgtatccaagtggagagcaagatgtatgccgagcttcttggggtacatcgagaaggaaggaaagcttccggtacacctgacattctcgctggcagccctgatggcattctatacaggaacagagatccgcgacaaggcgctgatcggacaccgcgacggacaggagtacaatattttagacgacgctgcggtattggagttcttcgcagccaacagttctaagggcgcgagagagtatgcacatgcagttctctccaacgaggcattctggggacaggatctgagcgctcttgcaggagtggaggatgcagttgcttcctatatagaagagatccgcgcacttggaatgcgtaaggcaatggagaagatttttgcataatacactgtgaaaaacaggcaggagacgattcatgaaggattttatcaagatcaatgaaaatgataatgttatcgtggcattgaaggaactgacagccggggagaccattctggcgggaacacaggaggttacagcaagggaaacgatcccggcgggacacaagatggcaatccgcgatattgcggccggagccgaggtgatcaaatacggttttaggatcggcaatgcgaaggagaacattgcagcgggacagtgggtgcatgtacataatttaaagacggcactcggcgatctgctggaatacacttatcagccggtggagacgaatgtgaaaaagacagaggatgtcaaattcatgggcttcgcccgcgccaatggaaaagttggcgtccgcaacgaagtctggatcatcccgaccgtcggctgtgtcaacaatattgcaaccgcaatggcgaaggcagccaacgcaagagtgaagggaagcgttgaggaagtcatcgcattcccgcatccgtatggatgttcccagatgggagacgaccaggagcacaccagaacgattctggcggatctggtaaatcatccgaatgcgggcggcgttctcgtgctcggactgggatgtgagaacagcaatataggcgaattgaaaaaatacatcggcgattacgatgagaattgcgtaaaattcctggtttgtcaggaatgtgaggacgagatggaggagggagcaaaactcctgaatgaactcatcgattatgcgtccgcgtttgagcgcgagccgatcagtgcctcaaagctgattgtcggaatgaagtgcggcggcagcgatggattctccggaattacggccaatccgctggtgggcagattctcagatcttctgatcggaaagggcggcaccacgatccttaccgaagtgccggaaatgtttggcgcggagacgcttctgatgaaccgctgcgccaacagggaactgttcgatgagacagtctcactgatcaacgacttcaagcagtatttcaaggacaatcatcagacgatttatgagaatccgtctcctggaaataagaagggtggtatctcgacactggaagataaatcactgggctgtacacagaagtccggaagcgcaccggtgtgcggcgtgctttcctatggagagtgtgtaaaaacctcaggattaaacctcctgtctgcaccgggcaatgatctggtggcggcgacggcacttgcggcgagcggcgcacatatcgtactgtttacgacagggcgcggaacaccgtttgcgtccccggttccgaccgtgaagatttccagcaacagtacgctggccggaaagaagaaaaactggatcgacttcaatgcgggcgtgctggtggaagacgcggagttagacacagtgggacagcagctgttcgactatgtgatcgacgtggcgtccggcagaaaagtctgcagcgaggaagcgggcttccacgatatggcaatcttcaaacagggcgtgacactgtagctgaaaagcagtagttaagcaatcgatgcggctttcggccactgcggctgatgccacatgaataatagaaaaggagaacataaaaatgggaattttagacaatttttcacttgagggtaaagtagcacttgtaacaggtgcatcttacggaatcggttttgcaatcgcaactgcattcgcagaggcaggcgcaacaatcgtattcaacgacatcaggcaggaacttgtggacaagggacttgcttcctatgaagagaagggcatcaaggcacacggttatgtctgcgacgtgacaaacgaggagcaggtggaagccatggtggcacagatcgagaaggaagtcggaacgatcgacattcttgtcaacaatgcaggaattatcaagcgcatcccgatgcttgagatgaaggcttctgagttcagacaggtcatcgatgttgacctgaacgcgccgtttattgtatccaaggcagtcattccaggaatgattaagaagggtcatggaaagatcatcaacatctgctctatgatgagtgagctcggccgtgagaccgtatctgcatacgcagctgcaaagggcggattgaaaatgcttacaagaaatatcgcgtctgagtacggcgagcacaacattcagtgcaatggtatcggaccgggttatattgcaacaccgcagaccgctccgctccgtgagatccagccggacggctccagacatccgtttgaccagttcatcattgcaaagactcctgcagcaagatggggcacagctgaggatctgcagggaaccgctgttttcctggcttccgatgcatccaactttgtcaacggacacgttgtatatgtagacggcggtattctggcatacattggaaaacagccacaatagactacattccgcacatatttgcccatgaaaacatttctaacaaaaaaaagctaaaatatgaaaaaaagtagtgcatttttatgaggactgtgctataatacaacatgtaagcacttacattattgcaatgtgactaaaacctttcagagtgcaaaacgatgaaagggcacattgccaagtaataaagaaaaaggagaagaaaactatgaaaaaggatttcctgaaacgcacaatggctaccggtttagtagcagccatggcactttctaccgcagcctgtggaagttccacatctgaggagacaaacacagacgcagcagccacaacaccggagactccggcaacagaagcagcggcagctacagaggcagcagctaccgatgatggttcttatgagaattgtacattaacaatgtcatggtggggtggtgacaccagacacgaggcaacattaaaggcaatcgaggcatttgaggcagcttacccgggaattaccgtagaacctacatacgctgcatgggatggatgggaagctaagatggctaccgcattcgcagcaggaaccgcacaggatgtaaaccagatcaactggaactggattacacagtatgacaacgatggaaccgctttccttaacctgaatgattactctaacgtaattgatttcagccagatcgattccacatatcttgatatgtgtacagcatctgacggatcccaggcaggtatcccgatttccatgacaggtagaattttctactgggacaagacaacatttgatgagatcggatgcgagatcccgaccacattagaggagttaaaggcttgcggtgagaagttcgcagcatacggagatgattactatccgttagctttaggtgagtacgacagaatgatcctcatggtatactaccttgagtctgtatacggaaccgactgggtaacagacggacagatcaactacacaacagaccagatcgcagagggacttcagttcatccaggatcttgaggatgctcatgtgattccttctgtagcaacaatcgctggtgacggtgctgcatctctggatcagaaccagaactggatcgacggacactatgcaggtatcttcgagtgggattcttctgcaagcaaattcgcaagcgcagctgagggacgtgagatcgttgttggtgactacttaacagatcttggcgagtatcagggcggatacgcaaaggtttccatgtgctgggcaatcagcgcaacatgcgagcatccgaaggaggctgcattacttgttaacttcttaatgaacaacgaagaagcagcacagatccttggctctgagagaggtgttccggtatctcagatcgcattaaagacagctaacgatgcaggcttattaaatggccaggtagtagaggctaacggtaaggttcttgcatgggtatccaacagccttgatccgaagttcgaggattctcagttaaagagcagcgatggtgtatactatgatgtaatggcaggtttaagctatggcgattacacagtagaggaagcagcacagacattatatgatggtgtaacagctgttatttcccagtaatctgactgcatgaattcggagctgctgttcttacgacagcagctccatttttaaaaaaggtgtatgatggattttgatcagtttgtatcagaatatatagcagaggatcatgattttgagcagctttcggtcatggttttggagggatgcagagcatggtatcccctggccgcggaagcggaaaagcaaaagctgcaagaggtgatggagaaagctgcccgtgcggcggtaggtgcccaccggtttggcaggtacgtattttttctgtatgatcagacgggagaagaacagtatcgcacctggatagaaagaaatgcagagtggcttaagaacagcccgcagtccgaaaacggcgtattcggatgcgtggaggattcttcccggaacatatccggcagtgtgatgtttgcggtgtatccattctatatggagtatgagaccagatatcacaacaaggcggagtacgcacagatcgtcagacagcttctgacactggcaccgtcggaacagacggatatggagcagacggggtggtatcttatgacggtgatcgacgtgatagatagcatgagtcgtgagattttcgaacattacaaatctctcgaagagatttttaagaagaccatcagaaatattcttgccgccggctggaataatgatttcagtaaaaaagaaagtgcaatgatgggatattctattataaaggcttgcaatctgggcgttttaaatagtgaaaaatatgcagaaattggactttccatgatcgatggtctgataaaagaaccgtttgattcaaaagattccgaacggatgggcatagccatgatggcttatgcgcagagactgattttaagtcgtgagtgaatgaaattttaagataagtaggaggtacaaaaggttggctaagaaaagtaataccgcaaatgttgcagtgccaaagaagaaaaaaacgtttgttgacatttgcaaagaaaatatcggcttcttctttattttgccatggttgtttggtttccttgtattcaaactgtggccgatgggttcctcattattctacagctttacagactacaatctgtttaagggcatgaatgtgatcggaacacttcagaactatgtgaatgtcttcacaaccaagaagattacgacagcgttgacggttacattcaagtatgcatttatcacagttccgttaaaactgatatttgcattgtttatcgcttacatactgaacttcaagatcaagggcgtgaatttcttccgtaccgcttactatgtaccttctatcttagggggatcggttgccattgcggtactctggaaagcagtattccgcgatgacggacttttaaacggattcctcggtcttttgggtattacaggcccgagctggctgtccgatacaaagtattccctgttcgtaatctgtctgcttcgtgtatggcagttcggttctgcaatgattattttccttgcagcgttaaagggtgttccacaggatctctacgaggcggcttcgatcgacggagcaggcaagtggcgtcagttcttctctgtgacagtgccgatcattacaccggttattttctacaacctggtaacacagctctgtcaggcattccaggagttcaacggaccgtacatcatcacacagggcggaccgagaaactctacaacactgatttcacttttgatttacaacagtgcgttcaaacagtatgacatgggtatggcaagtgcgatggcatgggtaatgttcgtcatcctgatgatctttaccacgattgcattcctgagccagaaatactgggtattctattctgatgaggagggctaagaagaatggcagcagaaagtaaaacaaaacattatgtcaatgtattcttaagatattttgtcctgatccttgtcggactgattatgatctatccgctggtctggatggttggtgcaacttttaaatccaatgcggagattttctccagcatcggtttcatcccgaagaacccgacacttgagggttacaaaaaggcaatggagagctacggcggagcaatcaacgtatggaaggctatgttaaacaccttttcctacgtaattccgaaggtagtatttacgatgatctctgcgacggttaccgcttatggattcggccgttttgagttcaagggcagaggaattctcttctccgtattgatggcgacattattcctgccgcaggtagtattgaacgtaccgcagttcatcatgttttccaagatgggctgggtagattccaagttatatctcccgatcattgtgccgaccctgttcgcgacggatacgctgttcgtattccagctgattcagttcctgcgcaacgtgccgaaggaattggatgaggcggctaagattgacggatgtaacgcagtacagactctggtgaaggttatcgttccgatgctttccccggcgatcacatccatcgcactgttccagttcatgtggtcatccaatgacttcatgggaccgttgctttacgtgaatactccggcaaaatatccgctggctattttcgtaaaaatgtccatggatgcagattccggattccagtggaacagaattctggcactgtccctgatctccatcattccttctcttgtggtattctttatggcacaggataagttcgtagatggtatttcagccggtggtgtaaaaggctaaaatcaaaaacaaagcttagaaaaagggtggcaggcttgtcacccttttgttgcactgtaagaagtaacgaatgaccgtaaggtataaatggaggatgagacaatggaaattcgtcttgtgatgaaaacggcgagaagcgtctcgctggaactggatgacggcggcatctataagacaaaagaagtgtaccggattcttgtaaacggagatgaggtaaagacaaccgataccgtcatcacgtcgctgtatggcttgaagccggataccgactatgagattggcgtggaggatgcccatggaaccagacagggagagattgcattccgcacggattacgagttcgtcacactcaatgtgcgcaagttcggtgcaaagggagacggtgtgtcggatgacaccacgtttatccaggcagcgatcatggcatgcccgcctgagagccgtgtgctgatcccggcaggaacctataagattaccagtctgttcttaaagagtgggatcagcgttgaactggcgaaaggcgcggaacttttggcggacaccgaccggtcgcactatgcaattctgccgggactcatcgagagctatgatgagacgggagactataatctcggaacctgggagggaaatccgctgccgatgtttgcgggaattatctccggaattgacgtttcggacgtgaatctctacggggagggcagcatcaacggagctgccagccacgaaaactggtggaaaaatgagaaggtgatggtgggggcgttccgcccgagaatgctttccttaaaccgctgcagaaacatccgcgtgcagggactttatttccatgacagtccggcatgggtgattcatccgtacttcagcgacgagctgctgttctgcaacctgatcgtggagaatccggcaaagtcaccgaatacggacggtcttgatccggaatcctgccgcgatgtgacgatctgcggtgtgcgcttctccctcggggatgactgtatcgcagtgaaatccggaaagatctacatgggaagaagatacaagacgccatcctccaatattcacgtctatcagtgcctgatggagcatggacacggcgcggtcaccgtcggcagtgagatggcgggaggcgtcaataacctgatcgtggagaaatgccggttttaccataccgaccgtggtctgcgtatcaagacgcgcaggggacgcggcaaggatgcgattctggacaatattatcttccgggatcttatgatggagcaggtcatgacgccgtttactgcgaatgccttctatttctgcgacccggacggaagaaccgagtttgtgcagtcgagagaaccgtatccggtggatgacggtacaccgtccatgaagcgcttctgctttgaaaatatcacggcgaaagactgccatgtggcagcatcctactttgacggtctgccggagcagaagatcgaacagattaccatgcgcaacgtatccgtttctttcgccgggcaggcaaaatgcgacgtgccgatcatgtcaaacggcgtggaagcatgctgcaaaaagggattgtatgcgcggaacgtgaagaagcttgtgctggacaacgtctccattgagggatgcgagggagaggagatcgaacttcacgacgtggatgaggttgagcgatagaaggcggccggaacattggcggggcaggagaaagaaagcccggaaaggatggaaaaaatgcagcttggaatacgtttacatgatatcaaaaaggcaccgcttgaggagcggcttgccattgcacatgagcagggatttgcctgcggacatctggcgctggcaaaggtgatttcagagtatccggtggatgacggtgccctgacgccgggatacgccatgtatttaaagaagatctttgcggcaaatcagctggatgtggcagtgcttggatgctacttgaatctcgccaatccgaatccggcaagccttgcaaagaatacgcaccgctatctggcacatatccggttcgcatcgctgctcggcgcgggtgtggtcggcacggaaaccggagcggtgaatgaggaataccgttttgaggagcgcaatcattccgaggaagcgctaaaaatctttatcaacaacctgcgcccggtggtttcctatgcggaaaaaatgggcgtgatcgttgcgatcgagccggtgtacaagcatattgtctgcaatccgaagcgggcgagaaaggtgcttgacgcgatcggttcaccgaaccttcagatcattttcgatccggtcaatctgcttgatgtttgcaattacaaggacagggatgctataatagcagaagcgatcgatgtgcttggcgaggatattgcgatggtacatatcaaggattttaaggtggagaataacagcctggtatcggtggcagccggaaccggcgagatgaactatgacaggatcatccgctttatgaaagagcgcaagccgtatatccatgcaaccttagagaacactgtgccggaaaatgccgtggcatcgcgcgaatacattcagagattgtgggaggagtgccatgtgggatagattttttgatctcgacaacgtggtttggcgtaccattgataaaatcggaaagatatttttattgaatctgctctggctgatctgttccctgccggtgtttacgatcggggcatcgacgaccgccctgatttacaccagcatgaagctttcggacaatgaagggtactggcatcagaattttttctcgtcgtttaaggagaactttaaacaggcgacggcgctgttttttatttatctggcagcgggtgcattcctggcgggcgacttccttttgggcggccgtgccggcaattccttcgggcagctgatgcagggagtggcggcaattctgtttgtaccgtattttctttcgctcctctatgtgttcggcgtgcaggcaaagtttgtgaatccggtcaaggcgacgatccggtattccttttttgtcgcaatgcgcaacatgaagacgacgatccagcttgcaatcttgatgattctgtttgtctgggtgaacacaaccacgctgcttgccaatttcctgacgctgatctatggaatcggtctgatggggtatttctttggaatgtactataagcatacgttcgccaaatatatcgaggcggcggaagaagactccgcagacgaagagcaggagcgttagcggacggacacgaagctgttccgacgaaaacaagcataatgaaaaggaattgtcgcaataagcatattgtgctttgttttgataagtaatattacaggaaatagatacttaaaagttccagataaacatgcggcgacaaattctgaccgcaaaatccggtatttctaaccatgccgcagctgacatccgtgatgatccgtgtctttccaagtttggagcactccacggactgtgtccgcaaaccggcagacaattttaggacttttgtgtgtgtcccttatggacacctctgagcaaaacataaccgcgcgaagccgatgtctgagtcggcatctgccttattttcaatagcagatgccggcgagtttcggttcgcgcggttttatattgtctgtgaagaggtgccattagggacaccagaaagtccgcccattgtctgcggcttgtcggacacactccgtgagtgtccaaacgtggccaagacacagaatgggatgccagccacggcatggaagaaatacgtgaattttgcttcaaagaatttgccgccgtctgtttattctggaacttttttgttctctggtattcctgtaatattacttatcgctcgaaagaggtctatgcttattgcggcaattctatgctgcatcagtcttcgacgacgcccggctcaaaggcgaccggggcggcggaggagccgagcggaacgcagtagctctgatctgtggaaaaatcacggaagtatacatattcggaagtgattgtaatgtccttgaaatttccctcgaacagtgtggtgtaaccgctgccgtccgtgcacatgaatccgagacacggatgttcggaatcgtttttctggaagtagatataatccccgtagaggttgtaccagtccacgcggtcctcggacagaagtgtcttctcaccggtggcaagatccgtgcgggcgatcgcgtagttgctgtcgcagtccatgaaataggcggtggtatcgtctatgacagtcggcatataacagttcccgccgtagagcatgccctttgagtcgtccgtggtattgagccgccagatatagtgatcgctgtcggttccgttgtaatacatatattcgccgtttgccgagcaggtaaagtcgggagcggtgtcgacctgcttgcagccggaaccgtcgatttttaccttataaagtgtggaaccctcggattcatcatagcggatatagtaaatataattcccgtagagggaagcgtagaggcacggcgccgaatccagaatcagaacggagtcatcgccgccttccctgtcaatgcggcagagactgtcggtgttgacagagagaaaggagagagcggcgcccgttgctcccggattgttgcgcacatagtagagataatgttcgtccgcgttgatgtaggataccgtgtcatcacagagcttggccagattgcttccgtccggagacatcgaatacagcttcccgccgtcggacgggttggaaaaatataccgtgccgtcgtactcgcagaagagaccgccgttgtagaggttgccagcggtgttgccgttcacgtaaccctcattaaaatgagtccggttggagagatagtggaaaatggcagccgctgcgataagcgcgataatgacgatgacagcaatgataatggaaatcttttttttcatggaatgattccttctttcgtctgaaatgccgataaaatataatcatggaaattataacattttcgtctaataacttgcaagggttctcttgtcatcagcacgttaatgtactatattataaactaaggcggagtcggcacaaaagagcacccggcggatgccctgatacgaaaaggaagtcagacggtaaggagcactatgaagaatctattagagttgagagatgagattgatgtcattgacaagcagatcgttgcgctgtatcagcagcggatgcagatcgcggctgaggtggcggaatataagatagagacgggcaaaaaagtttttgacaaagaccgtgaaatggaaaagcttgcgacgctttcggcgctcggcgacagcgcgttcaaccggcacggaatccgggagctgttcgagcagatcatgtcgatcagtagaaagcgccagtatcagctgatgacggagcacggcatatacgaaaagccggattttgaagagctggacacgttggattataaaaatgcgcgcattgtctttcaggggacggagggcgcctacacgcagctcgcgttaaaacagtatttcggtgaggatgcggggaacagctatcatgtggagacctggagggacgccatggaggcgatcgcccgcggggacgcggactatgcggtgctgccgattgagaattcttctgccgggattgtctccgagaattatgatctcatggtggagtacggtcactgcatcgtgggcgagcagattatcaagattgaacatgcactgctcggcgtgccgggagcgaagctttccgatatcacggatgtatactcgcatccgcaggcactgatgcagtgtgctagatacttagaaggacaccgggagtgggagaagcacagcttaaaaaacaccgcgatggcggcacagaaagtcagggaggacggcatgcggcacaaagctgccattgcaagccgtattacggcggagatctacggtcttgatgttctggaggaaggcattcaggacaacaagcagaatgcaaccagattcatcatcgtgacgggaaaacatgtgtttaccagaaaggcgaataagatcagtatctgctttgagggagcgcatgagaccggttctctctaccacatgctgtcccatctgatctataacgggatcaacatggatcacatcgagtccagaccgctgccggagcgcaactgggaataccggttctttgtagactttgaggggaatctgaacgatccggcggtgcagaatgcactgcggggattgtcggaagagacgaccagactgcagattctggggaattacgaagcgtaaagtgaggaatgtgggaagatgaagacaacgaagaatctgatcctctacagggattttgaaaacgagcagttattctatgactttacctgggtcatggagaactatcagaatgaatactataataaagaagatgttgagggattattctatgaatgcctcaaaaaactgatggagcttgcggtcagccacggattttccggcaatctctggcacaatttcctggcttttttgcttgtgaataacgagaatgcatacagcagggcgtgcgagatccgcggggagataaaaggctccatcaacgaggtggcgcggcacgattttgccatcatgaaagagttgtttgactttgacctttcggtgctcggcaactatttttccgtggactgcatggacgcattgctgcactatgaggagaccgcggacgcgggaaaattgttcaacaagcggatcagagaccggatcgcagagctctgccgtcatctggaggcagcggcggatgcagaagaatttaaacaggcggtcacggcattttacggggaattcggagtcggaaaactgggtctgcacaaggcattccgcgtcagacacacagatgacggggctcagattattccgatcaccaatatcgcgcatgtaaagctggatgatctggtcggctacgagcttgcaaagcagaagctggtcgacaatacggaggcgtttgtgagcgggaaggaagccaacaactgtctgctgtacggtgatgcgggaaccggaaagtccacaagcatcaaggcgattgccaaccagtattacgacagaggcctccgtctgattgagatttacaagcatcaattctgcgatctgaatgatgtgattgagcagatcaagaaccgcaactacaagtttattatctatatggacgatctttcgttcgaggaatttgagattgaatataagtatctgaaggcagtcattgagggcggtctggagaaaaagccggataatgtgttaatttatgcgacctctaaccgcagacatctgatccgtgagaagttctcggacaaggaagaggtgcgggaggatatgcacacttccgacacggtgcaggaaaagctttcactttatgcgcggttcggcgtgacgatctattacggcgcgccggataagaaggagttccagaagattgtcacgacgctcgcggagaaatatggcgtgcggctggagcaggaggagctgcttcttgaggcaaacaagtgggagcttgcccacggaggactttcgggaagaacggcacagcagtttatcaattatctgcttggaaaacaataaagaggagggcggatttatggcaatccatacgtttgcggcaatttatatcggttcgtatgaagtgagcctcaagatatttgaattgtctgccaagaaaaaaatacgcgatatcgactatgtgcgcagcagaatcgagctgggggcggatgcgtactccaagggcagcatcggctatgaactggtggaggcactctgcgataccctgcgggaatttgcgcagatcatgaaagagtaccgggtggatgcgtacgaggcgtatgcgtcggcggtactccgcgatgtggacaatgaactttttatcctggatcagatcaggctgcgtaccggtctgaccgtacatgtgttgagtaactcggagcaccgttttatcagctacaagtcggtggcgatgcgcgaggagtttgagcatttcatcggcagaagcgcagcggtggtggacgtcagtggatcgggacttcagattaccgtgttctcaaagggaaaggtgctgaccacccagcatctggggctcggcaccatgcgcatgcgggaacagcttgcaaaaaagagccggaacctggcgcagtatgaactgcagatcgaggagatggtggtaaaggagatggaagttttcaaggcgatgtatctggaaaaccaggagatcgaatatctgattgtgatcggcgattatattgcggaactggtctgccgccttgagaagaaccacaacaagaataccgtgtcaattgagaagttcgtccaatacatggaacagctcggcaaaaagagtctggaggagatcgcggaggaactggggctctccaacgagaacgatccgctgatcgtgccttatatcatcatctgcaagtgcatggcaagagggctgggcgcaaaggaactgtgggcgccgggcgtgattgtcagcgacggaatcgcctgcgactacgcgcagaaaaaccgtatctataagcccacacatgattttgatgaggatattatctcggccgcggaaagtctctcgagacgttacatgagctattcaccgcacattgaagcgctgacccagatggcgatgcttttgtttgacacgatgaaaaaacagcacggtctcggaaagagagagcggctgttgctgcaggtcgcggcgattttgcatgactgcggaaaatatatcagctttgccaatgccccgcagtgcgcatacgacatcatcatgtcctcggaaattatgggactgtcgcatctggagcgtgagatcgttgcggggacagtgctctacaacagctatccgcttgccgattatgaggatgtggcggaccggctcgaccagcagagcttccttacggtggcaaagttatccgccattctgcgcgtttccaatgcgatggatcgcagccacaaacagaagtttaaaaacgtaaaagcacagcttcgtgacaaagaactgatcattacgatcgagacggatgaggacattgcgctggagaaggcgctgttcgcttccaagacggcttattttgagcgcattttcagcatcaagccggtcgtgaaggaaaaacgtgtctattcgtaaggacgtggagggatgatacatggaaaaagaaaagaaaaacgaattccatttgccggaatattacgagaacagagagctaagctggctgaagtttgacgcccgcgtgctcaacgaggcaaaggataagagtattccgctgttagagcggctcaaattcgtgagcatcacgtcgtcgaacctggacgaattcttcatggtccgggtcgcgtcgttaaaggatatggtacatgcggactaccgcaagcgggatattgcgggcatgacggcatcggagcagctcgaccggatcaacacggcgaccagaaaactcgtcgagagccagtacaacacgtataaccgctccctcgttccgctgatggcagccaacggaatacacattattgaaaaatacgaggaactgacggctgagcaggcggcgtacgtggatcgctactttgaggaggacgtctatccggtattgacgccgatggcggtggacgcatcgcgcccgttcccgctgatccgcaataagacgctcaacatcgcggcgctgctttccagcaagaaggatgaaaagcataaggacgcggtggaatttgcaacggtgcaggtgcctggggtactgcctcgcctggtgccgatcccggcagatacgtcggagaatttcggggaggtggagggacgcacctttattctcctggagcagattatcgagaaaaatattgataagctgtttttaaactaccatgtgctctgcgcacatccgtaccgcgtcatgcgtaacgcggatctgccgatcgatgaggatgaggcggcagaccttttaaaagagatccagaaacagttaaaaaagagacagtggggcgaagttatccgcctggaagtggaagcttccgtggacaagaagctgctgcgctttttaaaggatgaactgaaagtggcggaggaggatatttttcagatatccggaccgattgacctgacatttctgatgaagatgtacgggctctccgggtgcgattccctgcgctacgaaccgtataagccgcagcgcgtgccggagattgaaccgggggaggatatctttgaggcaatccgggtcggcgacattctgctgcatcatccgtatgagacgtttgatcctgtggtcgattttatccggcaggcggcgtcggatccggacgttcttgccatcaagcagacgctctaccgtgtcagcggcaattcaccgattatcgcatctctcgcgcaggcggcggagaacggaaaacaggtgtcggtgctcgtggagctgaaagcacggtttgacgaggaaaataacattgtgtgggcgaagaagttagagcaggcgggctgccatgtcatctacggtctggtcggccttaagacgcacagcaagattgcgcttgtcgtgcgccgcgaggaagatggcatcaggcgctatgtgcatcttggaaccggcaattacaatgattccacggcaaagctctacacggactgcggaatctttacctgcaatgaggcgatcggggaggatgcgaccgcggtgtttaatatgctttccggatattccgaaccgctttcatggaacgaactggtgctggcgccgatctggctgcgcacccgttttatgcgtctgattgcgcgtgagacaaagcatgcgcgcgagggaaagccggcaaaaatcgttgctaaaatgaattccctgtgtgatgagggcattattgccgcactctatgaggcatcggcggcaggcgtagagatcgaactgatcgtccgtggaatctgctgcttaaaggtcggaatcccgggaatcagcgagaatatccatgtgcgttccatagtcggaaatttcctggagcacagccgtattttcttcttcttaaatgacggggaggaggaactctatatgggaagcgcggactggatgccgcgaaatctggaccgtcgtgtggaaattttgttcccggtgctggacgatacgctaaaagaaaaggtaaagcatattctggatgtggagcttgcggacaataccaaagcccatgtgctaaagccggacggagaatatgagaagatagacagaagagggaaggtgcttgtcaattcccagaagcaattctgcgaggaggcggttgcggcggtgccaaagacagatcatgtctaccgcgagcgtgtatttgtcccggcagaaccggcagagtaggaacgccgcaggacatatgatgggctaaaagcaggatgggaggaatgagtatgaatcacaagattttgtttgttgatctggatgcgacgctgctctctgacgacaaaacagtatccgaagaaaaccgggccgccatccagaaaatgcttcttgccgggcacgacattgtactctccaccgggcgcccggtggagagcggcagggcggttgcgagagaactggagctgacgcagccgggctgctatatgattgcctttaacggtgcggtactctacgactgcgctgcggaccgggtgctgttaaaacgctcgctcccgattgaggtgacgcaggaactctttgagagagccgcaaaggcgggaatttatgcgcagacctataataataccgagattattaccacaagacatacggcagagcttgagtattacaggaaaaaaacaggactttcctacaagctttcggcgaatgtgctggatctgctggaggaggagccgcagaaggttctcatgattgatttaaaaaatacggggcgtctcgcgcggttccgcgagaagaatctggaatgggaaaagggaaaatgtaccagctttttctcctgcagagagtatctggaatactgtccgcttgataccagcaagggaaccggtgtgtcctgtcttacgaagatgctgaatcttccgctagactgtacggtagcggtgggagatgaggagaatgatattgcaatgcttaatgcggcgcatatcggggtagcggtaaaaaatgccacgccggaggtgaaagccgcagcggattacgtgacggagcacgacaacaatcacaatgcgatcgccgaggtgatcgagcgatttatcctgtaaaaggagggactgctgcatcgggcgggcagctgccttgagtcgataaggaatattataagaagcacaccacgcagatttcagctggaaatgcagatggaacattcgtttgagaaaaatgtgagcatttcttcctgctggatgtttgcatcggattccgtgtctcttccacgtttggacacttccggagtgtgtccgacaagtcacagacaatgagcggacttcctggtgtccctaatgatgccgcttcgcagacaatataaaaccgcgcgaaccgaaactcgttggcatctgctattgaaaatacggcagatgccaattcaaacatcggcttcgcgcggttatgttttgttctgcggcatccataagggacacacacgaaagtcctaaaattgtctgctgacttgcggacacagtccgtagagtgttccaaacttgggaagacacggattatcgcggatgcaagcatccggcgggttagaaatgccactttttttgaacagaatttccatttgcattttcaactgaaatccccaagtgtgcctcttgtaatattccttatcgcttcaaggcaaactggctattcccgatgcgacagtcctttcttctgcctttatgcgcggaggtgttctttgatggtttcaagaacggaatagggaatgtagagatgcccgcgtccggtcccgatctggattgtgggtttgttggtgccgtggaagtcagagccgccgctgatgagaagcccgttctcttttgcaagccgcttgacgtactgttcctcgccggtggtgtaggtcgagtagatcgcctcgatgccgtcaaggtggacttcttttaactcgtcgatcagatgctgcaaggtcgtctggttcatgtggtagagcagcgggtgtgccagaacggcgatgccgcctgcggcgtggatcagttcgactgcctccatcggggagactttaaagcggccgacatagcatttgcagccgtcgccgatatatttttcaaacgcctccgagacgctcctaatctgatggctgtcgtagagaaaacgtgcgatatttgcgcgcgtgatgacactgtcgggattggcagcaaggagtgcttccgtggtaatggaaaagccttcgcgctgcagggcagccactattttttcattgcgcgcatcacggcagcggcggaactcgtttgttttctcgataaggagcgggtgctccggatcaatgtagagaccgacgatatggacttcttttccaccgccggctctggtgggcagctcatattccgtggaaagctcgatgccggggattaattcaataccacaggcggcagcggcgggagcagctttagagacacctgccgcggtgtcgtgatctgtgagcgcaaaggcggacagaccggcagcctttgcggcagatacgatctcggtgggagtaagggtgccgtccgactcggtggagtggacatgaagatctatgatgcggtgttccatggtaaaatcctctcttcagataatctaattcagactaatcatagagaaaaaaatcacatttgtcaaaaaaatatggaaaccagttgaacacgtagtaaaatagaactataatacaaaggtactaaaaaatatacacggatgtagagaatacagcacacaggaggagcgaaattgtttgaaaatgtacgaatcaaagagagactgacaaaagcatttgttatggtggcggcaatcactgccataggagcggtagtcgggctggcagcgatgcttgtgatgtcgaaccgttattccagcgcacttgtgaattacggtttttcacagggagatatcggcaaggcgatgatcacatttgccaacacgagatcagcgaccagaggaatcatcggatttgatgagcagggactgttggatgatgccatgacagaacatgacgaacagaaagcaaagttcgagaattacttcgcaaccgttggggatgtagtaacgacgagcgaggaaaaggcactctaccagcagatttcagataaactgcagcaatactgggcagcggaggaaccgatcatcgagcagggtgcaaccaccgatgctacacagtccacagcggcacagcagcagatgaaggaaagtctggatccgatctacgaagatatctatgcagatatgatagaactgatgaatacgaaagtgacggagggagaccgcttgtcctccactctgacggcagtcagcgtgattcttgcgattgtgattgtggcagtgtcagctctggcaatggttatggccaacaagcttggcaatcaggtggcaaagggaatctccggaccgcttgaggcacttggcgagcggtttaaaacgtttgcacagggagatctttctactccgttcccggaggtttccacgcaggatgaggtcgcagacatggcgcgtgaggcggcagacatggcagataagctgaatcttatcatcaatgatgcgggaagaattctcggattgatgtcacagggcaattacgcagtgcagtcggagcacaaggacggttatacgcttgattttgaaaaattgattgtggcgatgcgcgttctgcgcgatcagatgatagagacgctgacatcgatcgaagatgcggcaaaccaggtttctgccggttccggcaaccttgcagaggcatctcagagtctggcggagggcgcaacggatcaggcaggagctgtggaagaactgcaggcgaccatcacaagcattacagagaatatccagaagaccgcggagcaggcagaggaatcttaccagcaggcaaggcagtatgcaggtgaagcggatcagagcaagaatcagatgcagtccatgattgataccatgagccgcatcaacgaatcttccaacaagattggaaacattattacagatatagagaatattgcgtcacagacgaacctgctgtccttaaacgcttccattgaggcggcgcgtgccggcgaggcaggaagaggattcgctgtcgttgcagagcagatcagacaactggcagagcagagtacacagtctgcggtggacaccagagaactgattgaggcttccctcaaagaaattgaagagggcaatcaggcagtagagcgtgtgtccacgtctcttgaagaggtaattgacggaatcaagcagattgcggagacttccaagcgcttgagcgataattccaaggatcaggcagaagccatgaaacaggcggaggagggagtcaaccagatttccgaggttgtacagtccaattctgcaacggcgcaggagtcctcggcaacgagtgaggagttgtctgcgcaggcgattgcactggatgagctgattgggaagtttgtattaaaaaattaaaaattgacagattctgcggttgccgaaccgaaagaaaagggatataatagcaagaagaaaagtttcagaacaggggggaagtcacatgcagctgctgacatttacattaacgggaatggattatggaatatcacttgagaacgtggaatccattgagagtaagatgaatgtcgtggttgtaccgacttctcctgccaatatcagaggcatcatccgccttcacggagagatcctgccggtgttttcccttgcatccagatttggactggggaacattgcggtggacaaccttgtggttgtcaatgtgggcggcatgaagctggcacttgaggtggaaaaggtaaaggaaattgtggacgtggaagattccagagtgcttccgatgccgacactgatgagcggacagcagtgctgttttaatgatgtggcttcctgtcagaaggagctgattgtgatgcttgatgtcaagagtctggtatcacaggaggagcaggcggcgatccgcaagatgatcagcgacaacaccagcgacaaataataaaaaacacttgacacggatacgtgtgtgtgatagatttaaatagttgttagaaaacaaagtagagtatccactctcaccggagcacaaatacgtgactcatggttcatatttcaaagtattgcgaacatatcatgttccgggtttgaatgtttagtggatagtctgcctatccacttttttatttggaggtacgataccattagcgagttaatgattaacgaacagatcagagacaaggagattcgtctgatcggagagaacggagaacagcttggcattatgtcagcacgcgaagcaatgaagctggcggaagaggcagagcttgatctggtgaagattgctccaaccgcaaagccacctgtatgcaagattatcgactacggcaagtacagatatgaactggcacgcaaggaaaaggaagccagaaagaagcagaaagtggttgagatcaaagagattcgcttgtcgccaaatatcgattcaaacgatttgaacaccaaaatgaacgctgcgaagaagttccttagcaagggagacaaggtgaagatcacattgcgcttccgtggacgtgagatggctcatatgaatgcgagcaagcacattttggatgattttgccgcaagcctcggcgaaatagcagtagtggaaaaagcaccaaaagttgaaggtagaagcatcagcatggtgttggcagagaaaaaatcataattaaggaggaacatatcatgccaaaaatgaaaaccagcagagcagctgcaaaacgtttcaaagtaacaggaacaggaaagttaaaaagaaataaagcttacaagagacatatcttaaccaagaagacaaccaagaacaagagaaatcttcgtaagccggcaatgaccgatgcaacaaacgttaagaacatgaagaagattttaccatatttataggaataagttaaggaggaatgcaaaatggcaagagtaaaaggcggattaggcgctaagaaaaagcataatagaacattaaaattagcaaagggttacagaggcgcacgttccaagcagtatcgtgtagcaaagcagtctgtcatgagagccttaacaagttcttatgcaggcagaaaagagaagaagagacagttccgtcagttatggatcgcacgtatcaacgcagctgcaagaatgaatggtatttcttacagccagatgatgcacggattaaaggtagctggtgtggacatcaaccgcaagatgttagcagagatggctgtaaacgacgcacagggatttgcagcactggcagagctggctaagagcaaggtagcttaaggaacagcagacagaacctatctcgtatgtgggacaacccatatgagataggtttttttatgtaacaggaaagcaggattttttggtatcggtattatacagcatctgaattttgtatgttccaatttacagcaatatacggtataatattagcgatttttgaacgcaaagggaactacgaaagggaaacgggaatatttatatgaagaatatatggcgtatttttgcaaaagacattaagggactggtgaagaatccattcgcaatgattattgcgctgggactctgtgtcattccatcgctgtatgcatggtttaacatctattcaaactgggatccttatgcgaatacttccaatatcaagattgcggtcgtgtcggaggataaaggatacaccctttcggatggaacgacagagaacatgggcaatgaagttgtggaggaactgaaggagaataccaagatcggatgggtgttccttgaggattcggatgccgcacttgaaggtgtcaggaacggagattactacgcggctgtcatcatcagcgatagctttacatacagtatgtataatgtgttcaaggagaactttaagaatccgacgatcacatattatgagaatgaaaaacggaatgcggttgcaaccaagattacggataccgctgtatcgacggtaaagcagagcatcaacgagaagtttatcgaggtggttgcaagtaccatttttacacagacgaacgaactgtcctctgagatggagaatcaggatgtgttcagcgaatttgagggcaaactgaccaacctgaacaacaatctgatcggttacagtgatatgattgatgagtttatttcggcgaatgcagtgctggaggcagagatcaaaaccgcagacggagaactgccgaagctcagcagccagattcagaatggcgagaagagtttccagaattcgcagagcaatctgaattccacgaaaacttcactggagaatttcagcagcaatgtgcagacgacactggatggcatcaatcattcgatcaattccatcacaacggatatcaacaacgcgaacctggcgcagaatgcgcagtctacggcagacaatctgaacaagacggcaaccgatacggcggaactgatccgacagttaaaccagttgaagaagagtctggcagatcaggcggcaaattcatcgggaaccacaggctccacggagggcacaggctccacggaaggaacaggctccacggaggatacaggttccacagaaggaacaggctccacagaaggaacaggctccacggaggggagcggttccatagattcgatcgtgtccgatgaggtgaatcagcagattcaggagatcttaaataccttaaacagcatgaacaatggtgctgaggatattcagaatgcattaaatgctttgctccagcagggcggtggtacagacggctccggtcagattgttgcggatatggtgaacagatctgtggcaagcgtgacacaggtgttaaacaactgcagcgagtcgatcaccaatctgaagaatatgtataccaacagtcttgttccgcagatggacggagtgttaaacagtgtatcgcagatgctcggcaatgtgacaaagcttctggataacttaaataccgcagtaaatgatatgggcgtggtgtttgacggaattcagacaacggtcagtgacacgacggagagccttgagcagatccagaccgtgattgacaatgtgagcacaaagctgacggaactgatcaaacggttggagagtgcggaagatgatgaaaaagtagatgcactgctgaagtttttgcagggtgatccggaggattacggcgccttctttgcagaaccggtacaggtgacgacacaggagatctacgcgattgcaaattacggatcggcgatgacgccgttctattccgtgcttgccctctgggtaggaggaacgattctggtggcactgatcaaagtgaagccggataccgcagggctttccaacccgaagtcctatcagttgttcttcggaagatatctgctgttctttgtgtgtgggcagatccaggcggcgattattgttctgggagatatttatctgctccactgccagatcctctatccgggcttattctggctgacggcagcactggcaagctttacctttacgctgtttatctatgcgatggcgctggctttcggcgacgtcggcaaggcggcggcggtcgtagtcatggttatccagattgcaggttccggcggaacgtacccgattgagacgcttccggagatttatcagaagatttatatcttcttcccgttcccgtatgccatcaacgcaatgcgtgagacgattggcggtatgtacggaagcgattatatgaagtatctgggagaactgctgctttttgcggtggcggcgcttctgattggtcttgtgatccggcttccgtttgtgaagatcaatcattttgtagaaaagcgtatggaagatacggaaatgatgtaggaaatgggagattttatggaaaagaaagaaaaatacgaacagatgtatgagatgctcgtgacgtatgagcgcaagattcacgagaagaatcaaaagagaatcagtatcggtttaaagtgtattattattattccgttgatcttcctgttccttctgttctggacagagagcaataaggttgtgtttctgattctgtggattgtatcgctgtttttgctggcagcctatctgattctggtggagtatatggactataaccttcaggaaaagttaagcgagatcaacgacgaggggacacgcgtggattccctcatcggactggagattgataatgttccgggaaatctcagaaatgtgattcagaggattgacgacggattaaactcagaggcggagacccggctgattgagactaaggcatccggggaagaaacgcagactgtggaaaaggcacagactgcggaagagacagagaaacaaaaggatgcggatgcacaggctgtagaagatgcagatgcacagaaagatgcggatgcacaggctgtggaagatgcagatgcacagaaagatgcggacacggaggtgaaggagaatgcgtaatatatttaagatttttttcgccgatgtcaagcgcatcagcaccaacgtggtggctgtcgttgtgatcctgggactctgtattctgccgtctttgtatgcatggtttaatattttgtcaaactgggatccgtacggaccgtccgcaaccagaaatcttaagatcgcggtggcgtcggacgacgagggagtcacaattttagggaacagtgtaaatgttggaagcagtgtcatctctgcgcttgagtcgaacacgacgatgggctgggtgtttacggatacgaccgatgaggcgatcgacggcgtctatgatggaagttattatgcggcgctcatcatcccggagaattttacggaagatatgatcagtttcctcggcggagaggtggatcatccggatattatctattatgagaatgccaagaaaaacgccattgcctccaagatcacacagaaggccaagacggctgtgcaggagcaggtaaacagcacggtggtgagtacccttgcagagaccacgatgaaggtgacgaacgccctctcagatgtggatgcggaagattccgatccggcggagagtgttctggtaagactcaataatttaagcagcgacctacagagttacatcaatatattgaactcgtttgtcagcattatgaattccgcccagagtattgtggaggcgagtcagaccatgcttccgaatgtgaacaacatggtttccaacggtcaggcatccatcaacagcatggagagtctgctggttgcgggcaacagcacggtgagttcgacggcggatatggtgtcgtacagctttgacatgatgaacgattcgttaaataatgtgtcgtccgtcattaccaatgcgttaaaccgtctctcggagtattcccagggcacttctgtcacggtacagggcttatcggcgatgatgccatacgtgaggcagctgtttgatacttcggtatccgggtgggaggatacggcgccggaggatatgcaggcgcagatcaatgcaatccgcacgcagttggatatcatcactgcggacctgacagcgctggagaacaatgccgatacatcgatggagacggtaaggaatctcagtaataaaattgtgacggagattgcaaactgccagaaagcggtcgatggactgcgcaatgattttgcttacaatgtcaagccgaagttagagaacacaatgagctccatgcagcaatccatgattgccgcagcgggtattttagacggcgtagatgccgattttaacggtgtggagaatgcactttccgattatcaaagcacgcttgagcgtggaagcaacagccttggcggatcactgtccatggcgcaggagcttctcgccaagctaaacagcgtcacggcggatctggtaagcttacagcagaatgaccagtatcaggagctgcttgaaatcgtaaagagtaatccggaggagctgggagcctttatttcttccccggtaaatctggagacggtcggtatctatgagattgaaaactacggctcggcgatgtctccgttctacacgatcctcgctctctgggtaggagcgctgattctggttgcgatcatccacgtgaaggtgcatccggttgagggcgtcgaaaatgtgaagccgtaccaggagtatttcggaagatacatgatctttttcctggtggggcagacacagacgcttttaacggttctgggcaacctgttttatattaaaatccagtgccatcacccggtattattctggctggcaggcgctgtggcgagcctggtatttaccctgtttatttactcactgaccgtggcattcggcaatgtcggtgaggcgctagcgattgtggtcatggtaatccaggtagccggtgccggcgggacgttcccgattgagacgctgccgaaggtataccagatgctctataagtatctgccgttcccgtacggcatgaatgccatgagggagacgatcggcggactttataagatggattactggaaggatctcggagcgctcggtatctatgtattgatttcactgtttatcggacttgtagtggcaattccgttccgcaaactcaatcatattatcgagaagaacaaagagggatccggagttatgatataatgaactctgacgagttcatattagaagttcctgcggaacttcagatgcgcaaaaagcagcgcgaagaagatgatatagcaacagggagcagattatgatgcgtttgatacaaatggttcttttactcacggggctgctcatggtggcagctcccggggcatgtacaagaaaagatgaccggggtaagccggagaccgagaagcgcacccgcacgattgggggatggctgactgcggcagcggttatctggatgattacggaagtattgagaagtttttaagttattttgggtattcctaataggtatacccattttttgttcggatattgacaaaaaaaatgtacattgttattatcaatggtaagtgtgatgtgtaatttcagatagtaaggaaggttttcttaaatgagaagacaggtattatcgcttctggtcgagaataatccgggtgtgacgagtcatatttcggggctgttcagccgcagaggctacaacattgacagtttttcctcgggagtgacagcggatccgcgctatacgcggattacgattgtggcgagcggggatgaacagattttagagcagattgaaaagcagcttgccaagcttgaggatgtggttgacattaagaagctggagccgggctcgtctgtgacgcgcgagctgattatggtcaagatacgcgccagagatacggaacgccagccgattttaaatgtgacggagattttccacggcaagattgtcgatgtgacacacgattccatggtgattgagcttaccgggcatcaggataagctggaagcatttctggatctgctgcaggggtatgagatcctggaactggcaagaacgggaagtaccggtctgtccagaggaactgccgatgtgaagatgatcgacgaaaacggacatctgcagagtttgtaatacatactaattgtgaacgagcggcagacatcacagatgctgctgctatgtataaaaaatggaggaaaaagatatgtcagcaaaaatattttatcaggaagactgtaacctttcactgttggatggtaagaccattgccatcattggatacggaagccagggacatgcacacgcattgaacttaagagattccggatgcaaggtcattatcggtctctacaagggcagcaagtcctggaagaaggcagaggagcagggatttgaagtatatacagctgcagaggcagcaaagaaagccgacatcatcatgatcctgatcaatgatgagaagcaggcggatctttacaaaaacgacatcgagccgaaccttgaggaaggcaatatgttaatgttcgcacatggattcaacattcattttggatgtatcgtaccgccgaagaatgtcgatgttaccatgatcgctccgaaggctccgggacataccgttcgttccgagtaccaggcaggaaagggtactccgtgtctgatcgctgtagagcaggatgcgaccggcaaggcacaggatctggcgcttgcctatgcacttggcatcggcggagcaagagctggcgtgcttgagacaaccttccgcaccgagaccgagaccgatcttttcggtgagcaggcagttctctgtggtggtgtgtgtgcactcatgcaggcaggctttgagacactctgcgaggcaggatatgatccgagaaatgcatacttcgagtgtatccatgagatgaagctgatcgtagatctgatctaccagtcaggtttcgagggaatgagatattctatctccaacacggctgagtacggcgattacatcaccggaccgaagatcatcacagaggacaccaagaaggcaatgaagaagatcctctccgacattcaggacggaacctttgcaaaagagttcttactggatatgtctccggcaggaagacaggttcactttaaggcgatgagaaagcttgcttccgagcatccgtcagagcaggtcggcaaggagatccgtaagctttacagctggaacaacgaggctgacaagctgatcaacaactaagagctaagagcggagaatgaatccgcaaaaagaatagagaatctgccgcatggagtgcgaagtgcttccggcggcagattttttatttcataggaaataccgtgatacattcatgtgtgaaagtggaactttcctatgaaataaaaaacgctccgcgaggatgcgcagctcgcggtaaggaaaatatcgctttgcgaaacgcgagcgcgcggagaatctcgcaagcgagattcttttttatgtggatgccaaaatccggttgacaaatacatccagtatgttaaaataaatcatgttcatgcataaaatgaatcaaagtatgtgaccgtgagaaggagcattaagaacggaagaatgacagagagccgccgggtggtgtgagacggtatttggaagttcccaactcgcctttgagtcctttgccggaagccagtggcagcgccagcggtgtgtaaggcagagcgtgtgattcgcgttaagaatgataagtgcgtacctgcgcatagcgcggtgcgaagcagagtggtaccacggagtagcgttacttcgtctcttacggcagatgtcgggagacggagtttttttgttatttcaagcgttaatgaaagatgaggagagagaagatgtcagaactttacaatcacaaagttgtcgagaaaaaatggcagaaagtctgggatgacaacaaggcttttgcggcgacagacgattacagcaagccgaaatattatgcactggtggagttcccgtatccgtccggacagggactgcacgtaggacatccgagaccgtacacggcactcgatattgtggcaagaaagcgccgtatgcagggatacaatgtgctttatccgatgggatgggatgcatttggtctgccgaccgagaactatgcgatcaagaataagattcatccgaagatcgttaccgagaataacgtgaagcgttttaaggagcagttacattcactcggatattcctttgactgggacagagagatcaatacgacagatccgtcctattacaagtggacgcagtggattttcttaaagctgtttaaggcaggcctcgcttacaaaaaagagatgccgatcaactggtgtacttcctgcaaggtcggtcttgcaaacgaggaggttgtcaacggtgtctgcgagcgctgtggagctccggttgtccgcaaggtaaagagcgagtggatgttaaagattaccgattatgccgagaagctgatcgagggactggatcacgtggattacattgagcgcgtcaaggtatcccagaagaactggatcggcaaatcccagggcgccgaggtggatttctccatcaagggcaaggaggataagcttcgtgtatacacgacccgctgcgatacattgtttggtgttacttacatggttgtatccccggagcatccgatcatcgacaaatacaaggatgaactgaaaaactgggatgcgattgcggcataccgcgacgaggcagcgaagaagtctgattttgagcgtgcagagcttgccaaggagaagacaggcgtgcagatcgaaggtctgaccgcgatcaatccggtcaacggcaaggagattccgatctggatttccgattatgttctgatgtcctacggaaccggagcgatcatggcagtgccggcgcacgatgagcgtgactgggaatttgccaagaaattcaacctgccgttaattcaggtcgttgcaaagaacggcgaggaagtagacatcaatgcggctgcatttacagatgtggcaaccggtgttctgatcaattcggatttcttaaatggacttgaggtcaaggacgccaaggcaaagatgatcgcgttcttagaggagaagaagatcggtaccgcgaagaccaactacaagctgagagactgggtattctcccgccagcgttactggggcgagccgattccgatcgtacactgcgataagtgcggttacgttccgatcgatgagagcgaacttccgctgatgcttccggaggtggagagttatatgccgaccgacaacggagaatcgccgttagctgcaatgacggactgggtgaacaccacctgcccgtgctgcggcggtccggcaaagcgtgagacagataccatgccacagtgggcgggatcttcctggtatttcttaagatataccgatccgcacaacgacgaggcactcgcaagcaaagaggcgttaaaatactggatgccggttgactggtacaacggcggtatggagcacacgacacttcatctgctctactccagattctggcataagttcctctacgatcagggggttgttccgtgtccggagccttaccagaagcgtacttcccacggcatgattctgggtgagaacggcgagaagatgagtaagtccagaggaaacgtcgtaaacccggacgatatcgtaagagagtacggtgccgatacgttaagaacctatgagatgttcatcggtgcgtttgatttgagcgcttcctggtcggaagatggcgtcaagggatgccgccgcttcctggagcgtatctggaaactgcaggatatcatgaccaacgaggagggatactcttcggatcttgagacaaagatgcatcagacgatcaagaaggtaagcagtgattatgagaatctgaagtacaacacggcgatcgcagcaatgatggcgctgctcaatgattttacaaagaagggctccatcacaaagggcgagtacaagaccctgctcattctcttaaatccggtagcaccgcatatcacagaggaactctggcagattatcggcggcagcggctatgtatatgagcagacctggccggagtacgaggaagcgaagaccgtagaaaataccgttgagattgcagtgcagatcaacggaaagacgaaaggaacgctggcaatcggaagagatgacgcgaaggaggatgtcattgccaaggcaaaggaatccatcgcagataagctcaccggcaacatcgtaaaagaaatctatgttccgggaagaattgtcaacattgtaatgaaataagatatggaaaaaggaacgaagcttttagaaggttccatctggaaaggggttgtagcatttgcaatccctctcttcttgggaaatttatttcagcagttatataataccgtcgattccctgatcgtcggcaatttcctgggcagcgatgcgcttgccgctgtcagttcatccggaagtcttatttttcttctggtaggattttttaacggaattgccgttggcgcaggcgttgtgatctccaaatacttcggggcgagagactatgagaatctgaaaaaagcggtgcatacggatgtggcattcggacttgtctcaggacttttgctcaccgtgatcggcatgtttttggcaccgcagattctggtgctcatggggacgccggagtcggtactgccgaattcaatcctgtatttccgcatttattttgcgggatcgcttgcatttgtcatgtataacattgtgatgggcattctgcaggcggtgggagacagcaggcatccgctgtattatctgattttttcttcgatcgtgaacattgtgctggatctgctgtttgtcggtgtccttagaatgggcgtcggatcggcggcgcttgccacggcaatctcacaggcggcgagtgcgctgctctgttttatccggctggtgcgcacgaacgatatttatcaggtaaaaatacgggagatccggtttcatccggcgcagcttcggcagattatcagctttggtctgccctccggtctgcagaactcgattatttcgattgccaacatcgtggtgcagtccaatattaacaagtttggcgtgatggcagtcgcaggctgcggtgtgtattccaagatcgaaggttttgccttcctgccgattacctgttttgcgatggcactcacaacgtttatcgggcagaatctgggcgcaaggcagtatgaccgggcaaaaaaaggcgcggcgttcgggattgtctgttccatgacacttgcggaactggtcggcgtgatcgtgtatatgctgatcccgtacctggcggcagcctttgacagcagtgccgaggttgtgggatttgcaacgcggcaggcacacgtggaggcgctgttttactgtttcctggcgttctcacactgtattgccggaatcatgcgcggtgcgggaaaatccgcggtgccgatgttcgtgatgctggtttcatggtgtatcatccggatcacatacattacgataaccgtgcattttattccgaagatccaggtgatcttctgggcgtatccgctgacgtggtcgatcagctcgattattttccttgtgtatttcctgaaagcggactggattcacaattttgaacgggcagaacagagataagaaaatgtagaacatggggaaaaagcgatgaaaaatgggcagaatggctgctggtggcaggggctttatgtatgggtatggcaggctgcggaagtgaagaaaaaaacacgtcgaacgcagatgcagaacagaaaagtgagactgcatcagagacaagagaagaaggacaggcaccggagcagacggatacagaaggaagcgaagaggcagaattacagacaacagagtcagaacatgcagagacgggactcactttcgcagatcttgcagcgctgcagtttgaattttgcagtggtgcaggtggatggtcaacggattttaccattgagaaggatggctctttttccggcgtatatcacgattcagatatgggggataccggggatggctatccgaatggaaccatgtattactgcaatttttcaggacatttcacgaacttaacgaaggtagacgacgatacttatgagatgtcacttgcggatatttcctatcagaatacggtcggagatacagagattctggatgatatgctttatgtttacacggatgtctatggtctggagggaacggataccttccggatctatctgccgggtacgccgagagaaaagctgacggaagacgaatggttctggattgcagcgggaaatgagagcgaaacggaactgacgatgacggtgatcgtcaatgagccgaatgaatatggaatttattcctatgagaggtcaaccgcgtcagaggaagcgcagggaatatataatagtctgttgagctacaacgacgaactggaacagcaattacagagtgcctcaacgcagcaggaaatgaatgagattacggcgcagatgtaccagaatagtgacgatagcttaaaccagatctggcacatcgtgaaatataattcagatgagacagaattctctcagattctggaagaacaaaaaagctggatcacggaaaaagaggcggaggcggaaaagatcagagcggcaaacaatggttcttcggcagagatggatgtcaacataaagctaaatgatctcaccgaagaacgctgcagggaattgttggagtatttgaaaaattaaataaaaagatgatataaaaaaacaggaatcgttctctttctggcatacagggcggaatattcctgttttttgttattctacttggagtagagtgaaaaaatgtggcagatgtagtagaatagaaacagaaaggagagaggatgaatgattgataatgtgacgtttggaggatttgtccggacacttagaaaagaaaaacagatgacacagcttgaacttgcaaagatcctgaatctgtcggacaaaacgatatccaaatgggagcagggaaaggcatttccagacattgcagtctgggaagcgctcgcagaagcacttgatgtgacggtggcagagttgtttgcaggagaaaaactgccaaaggaagagggaaaagtcagtacagctatatttgaggatggcattgcagtggcagcaaatgaagtccggcaaaaaaagaaaagataccggggactgttgatgattatggcggcgctgttagtggtggttgcaggtctgggtatcggcaaaagcctgaaagagaaatttgcagtatatatggtcagcatggatgcaactattcttgaggttcatgaagattattgggaagttagaggaaaggtaacggatgccaaaggacgcagcggagtttatgacatcagtctgacagaaccatggtatctggagcacccggtggatggtaaggaaggagatgagatccgctttttttaccgggaggattggaaaaatagaactttgaaagaaaacgaatatatacaagggattttttctatggagaaagtggaggatgagtagaatcgctagttgggctataaaagaaaaaatctccgctgtttatttgcaaatagcggagagtttcctttaaaaattctgatagaactgaatgaactcattgagcgatttggaaggtttgctgttggtgcggtaggcgaaaccaacctcgcgcttgtgaatcggaatgccgagtggaatctccacgagggcaccggaggcgagatcgtcctgcacgaagcttttgatgacgcaggcgacgccgacgccgatcctggcgaaatcaatcagcagatccatgctggagatatcgatggaatcgtgaacaacgatatgattctcctgcagataatcgtcgatgtactggcgtgtcatgttgttctggtctaagagcatcagtgtggaggatgtgaggatctcgtctttgcggacgccacgggcatgcagattgcgcagatagtctttggtcgccacaaaaatatcctcgatctcttccagatagtcaaaatgtatattctttacattgtccggcttcccgatcagaccgatatcgattttgtcatcctcgagcagctttaaagtgtcgttcgtggattgacagtggatggagatcgtgatatgcggattctgccggatgaattcctttaagtagggaagcagcatgtatttgcaaagggttgcggagacaccgatcttcaagtgaccgaccccaagctcaatcgagcgctttaacttttcttccccgagtgtgagcgtctcaaaggcagtcttgacatgctcgtagagcagctgtccctcgtcggttaatactacgccgcgggaactgcgggaaaagagacggcagccgacgctttcctcgagcttctggatggatttgctgatggcgggctggctgatgtaaagctccttggcagccttggagatattgcctgtgttggctaccgtataaaaaatccgataggatgaaagattctggttcataatagttcctttccttgggggtgttgatttcatagatatttgtatctgttctgacaaaagtatatcatgaattaatgttatggtaaatatatttattatgtatttttattatagtatgtgctatgataaaatagtcacgaatcagatgaatattacacacacacgaaaatagagtttgatagtaggaggggatagaatatgggtatgacaatgacacagaagattcttgcggcacatgccggacttccgtctgtctgtgcagggcagctcattgaggcagatctggatctggttctcggaaatgatattacatcgccggtggcgattcatgagatggataagatgaaggtggacggcgtttttgacaaggacaagatcgcgctcgtgctggatcatttcgtgccgaataaggacattaagtctgcgcagcactgcaaatgtgtccgtgaatttgcctgccgccatgacattacgaattattttgatgtgggagagatgggaatcgagcacgcgctgcttccggagaaaggactcacggtggcgggagatgtcatcatcggagcggattcacatacctgtacctacggggcgctcggcgcattttccacaggcgtcggcagcacggatatggctgccggtatggcaaccggaaaagcgtggtttaaggtgcctgctgccatcaagtttaacctgaccggaaagccggcaaagtggatcagcggtaaggacatcatcttacatatcatcggcatgatcggtgtggatggtgctctgtacaaatccatggaatttgtcggggatggcatacagtatctttccatggacgaccgttttaccattgcaaatatggcgattgaggcgggcggcaagaacggcattttccctgtcgacgatctgacgaagcagtatatggagaagcattctaagcgcccgtatgttatctatgaggcggatgaggatgccgagtatgagcaggaatttacgattgatcttagcacgttaaagccgacggttgcatttccgcatctgccggagaacacgcacacgatcgacgaggtgggagagatcaagattgaccaggtggtcattggctcctgcaccaacggcagaatggacgatctgcgcgtggcggcatcgattctgaaaggacacagggtggcaaagggactgcgcgtgatcgtgatcccggcaacacagcagatttatctggatgcgatggaagagggtttgttaaagacctttattgaggcgggggcagtcgtttcgacgcctacctgcggaccgtgtctgggcggttatatgggtatccttgcggaacatgagagatgtgtctccacgacaaaccggaactttgtcggcagaatgggacacgtggagtctgagatctatctggcaagtccggctgtggcggcggcaagcgccatcaccggaaagttatccggaccggatgagattgcataggcgaggaaaggagacagagcatgaaagcagcaaagggtcatgtatttaaatacggagacaatgtcgatacggatgtcatcattcctgcacgttatctgaattcttctgatccgaaggaactggcgacacactgcatggaggacattgacaaggattttgtgaaaaaggtaaaagcgggcgatattatcgtagcaaataagaactttggatgtggttcgtcgagagagcatgcaccgatcgccatcaaggcttccggcgtgagctgtgtcatcgcagagacatttgcgagaatcttctaccgcaacgcgatcaatatcggactgccgatcatcgagtgtccggaggcggcaaaagcgatcgaggcaggagatgaggttgaggttgattttgactccggcatcatcacggacaagacgaagaacacttcctatcaggggcaggcgtttcctccgtttatgcagaagattatcgactgcgaagggctggttaattatatcaatcagaaatagaattaaccttttgggcaatctgttccagataattcagatagcgcctggagattttaagaccggtgtagatatctgcgtattccttcggggagagcgtatcgacatagttttccgggaaatttttttgaatgcctgccgcgcgggcgagatcaacggccttgttgtaggcaatggcggctttttcctcggaggagtagctgccgatctggtaattgccattgatgtggatgacggcgcggtaccgcgggagtccgttctttaaaaactggagcaccccgtggtaacggttgacgatcacaatattggaatagcggaagtcacttttatctccgttgacaaactgatagtctcttccggcaacagcgtaagggcggatgccgtagcgggagaggatggaatactgcatgccatagtcgctgacgaacagatgcccctgccgtttctggatcttgcggctggaatagtagaacaggtcgtcaacgtcaaactttaactcctcgatgcgcgagagatagtagctgaaatagccgttgcgcaggtagatcggattcttaaagtaaatgccgttgttgcggaagttcaaaagcacgatgattttttcaaaggagagggttgtgggctgctcaatataatcttccggcagctgatccaaagagcccagaatggcaagtgcttccagataggcattgcctgcggtggtctcatccgcatagcttccgagactgatatgtttatttttgtaatagagaccggcacggtagtagaccgtgccgtctttttttgtggcgatggatacaccctgcgtcataggtcacctcttgtttaccataaaaatattatgtaaataagcattaggatacacttttgtgatgagtatagaataacagaaggaaagacgggatgcaatagcggaaatccgattgacgaaaatatacaattttgctatactaagaagagttagatgtgtgcaggatgtcatatattttggaaggggccattcttaaatgaaaaaaatatcaacaaaagtattgatcccggtagtgctgcttgcagtgattgcagtcatttcggcggtaaccggattaaaaaatgccaatgagctgcataccagcagcaaggagatcagtgacacaacggtgaatcagctgatgctgttaaatgacatttcgtcgaattttaagagcattgatgcaatcacataccggatgtgcgtgtccacgtccaaggacgagcgcgatcagctgatggagcaggtggatcagtaccgcacggacattcagacgtcgattgattcctatgaggcgctgacacagacgcaggaggaagctgcggcaatggagacgcttcgggagaattttgccgattacaccgaggtctatgaccggattgcagactttatttcccgcgggaataaggacaaggcgagacagatatgcaatacggtgctggcgccgaccagcgagaatgtggacggcgtgctcacggagctggaagggtatatggaagcaaatgtggacgccggcgtggcggagcaggaatctgtatacaataattcgcgggcagtcagcggcgtcacatttgtacttgtgctggtgttctttgtcgttgcggtgatcggatcggtacgcactgttgtaaatccagtcaagagtgtgacgacacagctgaatgatattttaaaagagatcgagtccggcaacggagatctgacacgcagaatctctttgaagaacaaggatgagatcggacagcttgccggcggcatcaacgtgttcttagagaccctgcagcagattatgagccgtattgtgattgactccagggagatgggcgagatcgtatcgcgcgtttcgggcagtgtcggcacagcaaactccaatgcctgcgatatttctgccgtgatggaggaactctcggctaccatgcaggaagtggcgtctgccgtcaacacggtcaataccaatgtggcgcagatcgggcaggatgtgaatgagattacaaaagaatcacaggatatgaactcctatgcgaccgagatgcagagccgcgcggaggatatgaaggagaaagcggttgccaacaaggagacgaccagccggatgattacggatatcatcgagactttaaaggctgccattgaggagagcaagagtgtggatcgcgtcaacgagctgacggaggagatcttaagcgtatccagccagacgaacctccttgcactgaatgcttccattgaggcggcgagagcaggcgaagccggaaaaggatttgcagttgtcgcggatgagatacgaaagctggcggattccaccagagagaccgcgaacaatattcagtccatcaatgcgctggtaacgcaggcagtgaataagctcgccaacaattccaacgcgatcgtcgaatacatcgacgggacgatcatgccggattatgaccgatttgtagaaaacggcgtacagtaccgggatgatgcggcgtatgtgaacaccacgatggatcattttgaggagaaggcgcgcaacctgcagcagatcatggagaagacggtggattccatccgcgacatttccacggcgatcgaggagagtgcaaacagtgtcggaaatgcagcgagcagcacgacggttctggtgtccaatatcgacaccgttcattcggagatggagacgaatcagagcatcagcgaccgcttaaagggagaagccggacgatttaaaaatgtataatattttagtacgttagtgcattgacatgaatgtacagtttcttatataatgtgagttaagtatataagagactgtacattttttttgtacatcgcatgttacaagaagaaagagataagaggattatgaagatggaattagtgtatgcaagtacgagagacgcacaggaaagagtaacggcatcgcaggcgattctgcgtggtctggcaaatgacggaggactgtttgtaccgacacagattccggcgctggatgtgccgatggaagagcttggcaaaatgtcctatcaggagacagcatatgaagtcatgaagcgttttctgacggattttaccgaggaggagttaaagcactgtatcaattccgcgtatgacagcaagttcgacacagaggagatcgcaccgcttgtggaggcggacggcgcatattacctggaactgttccacggttccacgatcgcttttaaggatatggcactgtccattctgccgtatctgctgacgaccgctgcgaagaagaatcatgtaaagaatgagatcgtgattctgactgccacctcgggagataccggaaaggcagcgctggcaggattttccgatgttccgggaacgaaaatcattgtattctatccgaagaacggtgtaagcccgatccaggagaagcagatggtgacccagaagggtgacaatacgtttgttgtcggcattcacgggaactttgaccaggcgcagactggcgtgaagaagatgttctcggatgcggcgctggcaaaagagatggacgctgccggatatcagttttcctccgcgaattccatcaatatcggaagacttgtaccgcagattgtgtattatgtctacgcctacgcgaagctctatgcgaatggcgtgatcgcaaaggatgagccggtgaatgtcgttgttcctaccggcaacttcggcaatattctggctgcattttatgcgaaaaatatgggaataccgattgccaagctgatttgtgcgtccaacgagaacaaagttttatatgatttcttctccacaggcacatatgacaagaaccgtgagtttatgctgacaagctcaccgtcgatggacattctgatctccagcaatctggagcgtctgatttaccgcattgcgggaaacgacgccgagaagaatgccgcgctgatgagagaactgacgaccaccggaaaatacgagatcacgccggagatgagagcacagcttaaggatttctatggcaattacacaagcgaggcggagacggcagaggtcatccgcgcactttatgagaagacaggctacgtgatcgatacacatacagcggttgctgccggtgtatatggaaaatacaaaaaggataccggtgatgtagacaccaagaccgtgattgcgtccacggcaagcccgtttaagtttacaagaagtgtgatggatgccattgaccacaagtacgacagcatgtccgattttgaactggtggatgagctgagccggattgcgaacgtagccgttccgcaggcgattgaggagatccgcaatgcgaaggtgcttcacgataccgtgtgtgaagtggatgagatgccgcaggtagtaaagaatttcctgaaaatctaagaataaaaatgtgaaagacataaaaaagctgcacgccccgcgcgtgcagctttttttgataaatcttttttgataaacttatttttcggaacagatttcaaagatgaagtgaagcgttccaaacgggaataaaaccggcagaagataagtctcatgctcaaaggtaagcagatctttttcttctacaaccggagcctccagtgacagattcatggagaactcgtttgacatattgacacagaacagaccgttgtgcagattgataaaatcttctacagaagaacgcacatactcatcaaattctgtaaagttttcgttgacatacttggatgcaaaagcaatacatgtattctctggaatatcgagataagtccggatggaaaacgatccgcttactttctgtgatacgcagtagttggtcgggtattccttgcaactgctcggagaaaccagtgtgaaatcatctccgataaaccgatagagattattgaacaaaagctggaaaaaagagatttcatactttgagagcggacgctcagcgagaatgaaaaagttctcgatcatatggcggatggcatcctgatcttcctcggagtaactgtaatcgtccagttcgttctctgactgataatcaatgatcaactcctgcagctgctgattattgatgagtccttcgtccacaagtgcctgtccgagaagaagaaaatccggcttctgctctgcgagaagcttagtcacttccgcctctgtgagatatccctcatgaatggcgagttcaccaaaacgcttgtcctcgtgtgtctgaagaatgacgatacggtctacctcgtttgcggtcatatatccggcatgaatggcaagagtgccaagtttgatcttggttgaagacttccgatgcatggtttctaacagctgctccctggtaacgacaccgtgtgataataagtaatttccgaaaaactgagcgtacatagcttatctcccttcaaatcttgaagaaataatgtgatgaatctgttctgcattcagcggcttctggataaaatcgttagccccggcttcaatggcagcttttaactgtgtctgagtaccgacggatgaaacgacaataatatcagcatccttatcatatgccttgatctcggtaatggcagcaatgccgtcctttacaggcatgacaatatcaaggaaaaccaattcaggtgactcttttttgtagaggtcgatggcgtcctgtccattggaagcttccagaaacaccggagtaccatatgtggaaacaatatcctttaactgctttcttgcaagtatggagtcgtcgccaatgagaatcttaatgccatttaacatcataatgcatctcctctgtcatcataattatattcgcttctattttacactaacaagaaaaatagttcaatgaatatattgaattttgtaagaagaagatagataatgtaaaaaaatatgtcgaatcagtcgactggaatgagaggatacaagaatggacgtaatgctgatatttgatgtggtcatcgccattttcggggtatatatgatcgcagcagcacttaagatgaaaaagaccgggaagatcagctcggcggtcatcacggcggaggagattgccagatgcagaaaaacgaaggagttcatagcgtttatttactggaaagaggcagtgttcggcgcattgattatcgctgtgggtgtccttggaattatcaatgataaagtggtatcgctcggtgcatttaacgtggttgaacttttaatcttcctggcggcatttctgtggttccagtcccagctgcgcaaggcaagggaacagtttttataaaagattctccgaatcatcagatggcattcgcaggaacgtcacattgcgacgatatgatgtcaaaaacagggaggtatctgcgttatgagaagaatactggtagtagatgacgaagaaaaaatcagggcgattataagaaaatacggagagttcgatgggtacgacattaccgaggcaaaagacggcatggaggcggtaaagctctgcagagagcaggattttgacgtgattattctcgatattatgatgccggagctggacggcttttcaacctgccgggagatccgcaagaccaaaaacattccggtgatcatgctgtcggcacgcggagaagagtatgataagattcacggatttgaacttggaattgacgattatgtggtgaagccgttttctccgaaggagcttatgatgcgtgtaaaagtggtcattgaccgcaacggcggaagagattctgcaagcacgaacgggcatgagattttccaggcggaggggcttgtcattgattttaccggaaggactgtgacggtggatggaaagcgcgccgaactttctccgaaagaatacgacttgctgttttatctggtgcggaaccggaatattgcactggagcgtgaaaagctgattaccgaggtgtggggatatgattattacggggacgaccgtacgctggatacccatatcaagctgctgcgcagcagccttggggactaccgcaagttccttgtcacgttaagaggggtggggtaccggtttgaagcatgaaaaaatcagtatcaaatggaaaatctttttctatcttctggtgtttaccggaatccttttgacggtgctgtggcttgtgcagatctgttatctggacaagttctataagaagatcaagtcccaggaggcactggaactcacctcggaagtgattgcggtcttacagagcgattcccagaacattgaagaacagatcgatgcgctggcggcgcagaataacatgatcgtgtttgtcacggatacggacgggaataccatttacagcgcggaatatatcccgaattccaggctgtgcgagatgccgcaggagatgatacagaagctgtacgaagctggaatttgagggagatatcgggaagaatgattttcagaatccgcaggacgtgatgaatcccgatgcggcagctgatgcggcgggagccggaaatatcccggatgcagccgatgtgacaggagcgggagcagaaaatgccccggatgcggcagcgggtgccacaggagcgggaaactccccggatgcagccgatgtggcaggggcgggagcagaaaatgccccaggtgcagccaacggcgcagagcaggagactgcaggaatgccggcggagaacggttttatgcagaatcacggacaggaacggattgagagcgtcatttacgtgaacgtcgtctcgatcgatggaaatgagagaatcctgtttgtgaacgcgcagctgacgccggtggatgcgacggtcaatacactgcgtgccgaactggtatggatcacagtcatcatgattgttctctcgctcggtattgcacttttgatttcaagaaaagtgtcacgttccctgatcggtctgaatgcctccgcgaaggagatggcaggcggcaattttgacgttcattttgacggaaccgattaccgggaggtcgcggaactttccgataccctgaatatgactgcgcgggaacttggaaagagcgagcgcctgcggcgggaattgatcgccaatgtatcgcatgacctgcggacaccgctcacgatgatcattgcctacgcagaggtcatgcgtgatctgccgggggagaattctccggaaaatgtacaggtggtcattgacgaggcggagcggctgaccaatctcgtcaatgatatgttagacatctccaagcttcaggcaggtgtaatggaaaaaaatgtcacggtctacaacctgaccgagagtattcagtctgtatttgcacggtataataagttaaaagagcaggatggttataagatcgatttctcctacgaccagatggtcatggtggaggcggacgagtacaaaatcttccaggtcatctacaatctggtcaataacgcaatcaattacaccggggatgacaaacagatctgggtgcgtcagattgtgcgggaagacggatatgtgcggatcgaagtgacggacagcggcgagggaatcgctccggaggcgcttccgtatgtgtgggaccgctactataaagtggacaagacacacaagcgggcggtcatgggaaccggactcggactttcgatcgtaaaaaatattctggaactgcacgatgcacgctacggagtagagagtgaagtgggaaaaggttctaccttctggtttgaactgaaagtatatcagattgtttaaaagagctgcccgcggattgacggagcgggcaggaggaagcatgtggcaatatgcgaacttagaactccggctataatggccggcggttcttctgatcgtaaaatccggtgtttctaatcacaccgcgtttgacatccctgatgatccgtgtctttccaagtttggagcactccgccggatgagtccgcacgccacagacaattttagagctttcgtgtggcgcttataccgctgctgaacaaaacataatcgcgcgaagccgatgtttgaattggcatctgccatattttcaatagcagatgccaacgagtttcggttcgcgcgattttatattgtctgtgaagcagcggcattagcgccactaggaaggtcgctcattgtctgcggcgtgtcggacacagccggcggagtgttcaaacgtggcaaagacacagaataagatgtcaaacgcggcatgaaagaaacactcgcattttcctctaaagaagagccccgtccattacagacggagttctctcatctcgcgtattttccatagtattccattttgtccgctccgtcagtccggggcggcttttttagaacaaggcgtgcagtgaaaatcagacacgctcatccatcgggacataaatcttatgctcgccgacgtttttgtaggcaggacgcatgatcttgccgccgcctgcaacttcctccagacggtgcgcactccatccggcgattcgcgcgatggcgaaaatcggcgtgtagagttcgaccggaagtccgagcatgctgtaggcgaatccgctgaagaagtcgacattcgggctgacacctttatagatcttgcgctcggcggcaatgatctgcggggcaagacgttccactgccgtgtagagtgcgaattctttttcatagcccttttctgcggagagacgctttacgaatccgcggaagatctgtgcacgcggatcggacagcgaatagaccgcgtgtcccataccgtagatcagaccggcgtgatcgaacgcttccttgtggagcagggcagtcaggtaacggctgatctcctcctcgtccgtccagtccttgagattggccttcatatcgtcgaacatgcgcaccaccttgatgttggcaccgccgtgcttgggacctttgagggaacctaacgatgccgcaataacggagtatgtatcggttccggaggaagataccaggtgggtggtaaaggtggagttgttaccgccgccgtgttccatgtgaagaatcagggcaatatccaaaagctttgcttcaagcggcgagaacttgctgtccggtcttaaaatgtgcagaatattttcggcggtggaatattcttccttcggggaatgaataaacaggctcgcgccgtcatgataatgcttgtatgcctgataaccgtacacggataaaagcgggaaaagactgattaactgcagacattgtctgagaacattgggaagcgaaacatcatccgccatctcatcgtaagaatataaggtaaggacactgcgcgcaagcgtattcatcatgtccttgctgggcgccttcataataatgtcacgcacaaagctggtcggcagcgtccggtaactgctcagcagagccgaaaagtcgcgcagctcatgcttcttgggaagcttgccgaaaagcagcagataggtacattcctcaaagccgaagtggctgtcctcgggaagtccggcaatcagatctttgacattgtaaccacgatagaagagctcgccgtctgcgggaacagattcaccattgacaatttttgtggaactgacttccgagatctccgtcagtccgaccaggacaccttttccgttcagatcgcgcagaccgcgtttgacatcgtatcttgtgtataattccgggtctatttttgaacattcggcagactttgcggccagccgacgcagttcgggtgtaatttcacagaattgattcattgttagccctccttaatgttttcgtcttttcatcatagcatatgtacttatttttatacaagaaaattgaattatatttaatgaaaattttaaaatttaaaagaaaactggtaccttaaaaagggaaagtaccaaaaaatgctttcttttttcagaagagtctattacaataaaaaaggatcatcagatgtaaaaagggaggatacaggatggatctgaatatagagttgctggcaaaaaaggcaatcgaggcaaaggaacatgcgtatgtaccatattcccatttcagggtaggtgcggcgcttcttactgcagatggtaagatttatacgggatgcaacatcgaaaatgccgcgtacacaccgacgaactgtgcggagcggacggcgtttttcaaggcggtatccgaaggggagcgtgattttacggcaatcgccatcagcggtgacgcggacgattatctgtatccgtgcggcgtgtgcagacaggtaatgtcggagttctgcaaggcggatacgtttcagatcatcctggtaaaggaggacggaacatataagatttttaccttggaggagcttctgccgggcgcttttaccgagacagagctgaaaaaaggacagcggatgtagggcgtccgcaacagaggaaggagagcgttatgagatattcgattgagggagaaccgcttccggttgtaatctgcaatctggagcagggagaggtaatgattacagagagtggtgccatgtcgtggatgtccccgaacatgaaaatggagacaactggtggcggcatcggcaagatgtttggaagagcgctttcgggggaaagcattttcttaaaccgctacacggcaatgaacgggaatgggatgatcgcgtttgcatcgtcgttcccgggatcaatccgggcgtttgatattgtaccgggacaggatttgatcgtgcagaaatcggcatttcttgctgctgtatccagcgtggatctgtccgtgttctttcagcagagaatcgggagcggacttttcggaggagagggatttattatgcagaagctttccggaagtggaaccgcatttctggaatttgatggttatattaaagaatatgaacttgcatccggacagcagattgtcgtggacacgggttaccttgcggcaatgacaggatcctgtaagatcgaagtgaagacggtaccgggagtgaagaatatgcttttcggaggagagggtatttttaataccgtgattacgggaccgggaagagtgtggctgcagagcatgccgattgcgcagatggcaaatacgctgcgtccgtatttcccgagcaataatcattaagatgtgatgcacattctgcattcagaaaaaaatagaagtgtgcacagaatttggcactaatttttggttgcagatcggggcatattaaagtataataaaaccagtaagaaacagcctgggatgtgcgacaccctacatttttgaacctacatttacttttatgggattcttatatttggaggcagatgtcaagccaccagtaccgcaaggtacgcgagcagtggaaggcagaaaccgacatgcggttacccacctagctatagctaggagtcaaaaacgtaggaaacggcattttgggtgatacaaaagattccgagagatacaacagaagcttacagtacgagagagaacctgtcaggatacgaaggatgacggatacgaaagatagatcaggtaccaaagagttgaaaagttacggaagaaagaagctgcctttgtgtgaggcagcttctgtttttttactcttttgcagagaattctggggcaaggcataaagcgtgatgggaagtggaaaatgggaaagagaacaaaaaagagaggcgtaaaggcatacatcgccatcgtatgtctggtgcttttgcttgcggcgggtgcgcttgcgtctggatatcgggacagacagttaagggagcaggaaacattgcccgaagagtgggtggaacttgcggaaataaaagaagaactctcctttggagtatacgggcaggaagactggaattccttttttgagacgttttcaggagacaggctgaccggggaaatactgggagaactgctcgcaaagctgcagctgtccgattacatagagatccccgtcatgagggaatcgcagaaagtgtcaagggaagactggaattacgtctacggtcagattctggatctgctcgatatggaatatgccgtgacgaaaacggagtttctggttgtggatgtcatggaggcggagaaccagaatgtgattatgacgaataagggagatttttgcacggtgcttccagcttcatattttaagcagtggaacggatatgagggctactgcgtggaaaaccggtgcatcggagtcgcgggaacgctgaagaaggaatttacgctggacaacacatatcttacggactgcaccaaagacagcgtggattttctgtatgcgggcgcggtgtaccacaaggagacggcgtccctgacagagggcgtttccccctgtgtatgcgatattgtgctggcggacggggaacttacggcactgcgtgtaaagcaggagaccatcgagggagaactgttgtcctatgacgatgagaccatcgagatcaaaggatacgggaagctttgccataccggaaaactgccagtgtaccagacctatggggaagtgtcggaaaaatccatttccgatgtgaccctcggcaatatgaacgtggagtatgtgacgggggagaagcaggtctgcgccattttaatccgcgagccggctgtcatccgcgaaatccgtgtgctgctcctgggggatgacggaacaaaatgccggcagtccgtctatctgaaatgtacgtcagacgcagcggtcacctggcagggagagacaacacatgtggcagcgcagacgctgattgctgcatccgatcagatgacaggagatacacagggaacatttacggtgacgccggagcaggagggctgtgtggtgatctgcgatgcagatggcgcagagatttccaatggctacgggggcagcatggaagtgcggtgcatgggagacggctatacgctggtcaacagtctgccgctggaacggtatctgcaggacgtcgttccgagtgaaatgccggcatcctatgaaccggaggcattgaaagcacaggcggtctgcgcgcgcagctatgcctgtatccagctgcttcggggcgatctggcggaatacggcgcacatattgatgacagcaccgcgtatcaggtatacaaccgggtgacggacgcggacgcagccagggaggcggtaatcgccacacagggggaagtgctgtcctatcagggaaacatcgtggaggcgtattatttttccacgtcgatgggatacaccgccgcagccgatgtgtggaatgtggaagatccggcggaatacggctatctgacaccggcgtgtctccttacggatggaaagatgcaggatctctccggggaggaggcgtttcttgcttatattcagagtcccgcagatggatacgacagtgactgccggtatttccgctggagagcggaggcggattaccatgggaaaacagatgaagtgaattccatactgctggaacggcggaagagttcgccaaagaatataatcttttatcaggacggtcagactacggaaatacagaattccgatgcggcatcagtggcggcactgggggaggtgaccggcatgagcgcggcggagcgcggcagctccggtgcactgcttgccttaaagatcacgtatgagaagggaagcgcccttgtgcggacggagtataatatccgaaaagttctggggatctgtaccgcaaaactgacatgcgcagacggcgcggaacagacggatgtgacgatgctgccgagtgcgttttttgccataacgaaacaggaggacggcggcatggttttatacggaggcggctacgggcatggactcggcatgagccagaatgcggcgaatggaatggcgaaggcaggaatgaattacgaagagatcttgcaatatttttataatgacgttaaactggaaaccatgaaataatgaatcctgacggattcgctttttgaaggggagcaatatgatctggaagcttattggtaatgtcaaatcctttcttgataaatgcaagagggataagatcaatgcctattcggcgcagtcggcgttttttattatcttatccatcattccgtttctgatggtgttctcgtctctgctgcaatatacatcggtgacagagtccatgctgcttgagatcatccgtcatctgatgccggagtatgtctctccgtttctgatatcgctcgtggatgaggtgtacagcagatccatgggaattatctcaatcacggcgatcatcgcgatctggtcagcggccaagggcgtccagtacatgacggacggactgaactcggtcaatgatctggaggagacgaggaactggtttgtgctcagattctgggcggtcgtctatacggtggtttttctggtggcgattgtttttaccctgctggttctggtgttcggaaaccagttaaaggtacttgccacacagtacgttccgattttagagcatgcctcgcgggtgctggcacatttccgcgggcttgtgatgctggcgcttttgattgcatttttcgatgtaatctttacggcgctgccgaaccggaagctttccttccgcgggcagctgccgggggctgtgatctgcggggtagcgtggtatgtcttttccttcggactgtctgtctacgtggactattttaacggtttttccatgtacggcagcctgacgactattgccttgattatgctgtggctttacttctgcatgtacatcatgatgatgtccgccgaggtaaatgtggtgttcaacgcttacttccgcaaatggtggaagcgctttaaaaccagcaggaataaaaaagcttgatgttttgcgcctgctgtgctaaaatgctatacagaattcagaaaaatcaaaggctgtgaatgtgtacggaagcgattccgggtatcgtaagatatcagtagagtgcaggagactctttcagagagagcgggtcatcggctggaagcccgtttaggataagacctggacttgaagttcgcacaggagctgcatctgtgaagtgaaagtagtggatgacgtcggatacacgttacgtatgaattgagagcttttctttggtgatatgaagagaagaaacagggtggtaccgcggaatcattcgtccctagagcagggatggatggttccttttttgatgtctgaaatagtttaaaggagaattagaaatgaaagaaaaattgcagcagatcagagaaaaagcaatagcagagattgaagggtctgatggattagaccgcctgaatgaagtccgccaggcagtgcttggaaaaaagggtgaacttactgcggtgttaaagggaatgaaagacgtagcgccggaagaccgcccgaaggtcggacagtgggtcaacgacacccgcaccgccattgagacgatcatggaagagaagatgaaaaaactggaggctgaggcgctccggaagagatatgaggcggagaagatcgacgtcacaatgccggcagtaaaacacgaaaagggcaatctgcatccggtcacacaggtgcgcaaccagctcattgacatttttgcatccatgggatttgaagtgtacgagggaaccgagattgagaccgactactataacttcacagcgttaaacacaccgcaggatcatccggcgagagatatgcaggatacattttacctgtcaccggaatttttactccgcacccagacatctgccggacagattcatgtgatggaggcgaagaaaccgccgatcaagatcatctccccgggcaaggtgttccgttccgatgacgacgcgacacattctccgatgttcacccagatggagggtcttgtggtagacaagggaattaccctctgcgatttaaagggaatgttagatgagcttgtgaagaagattttcggaaaagagacgacaacgcgtctacgcccgtcctacttcccgttcacggagccgtccgtcgaggtagatgtaagctgcttccagtgcggcggatgcggctgtaagctctgcaagggaaccggctggatcgaagtgctcggagccggcgtcgtcaacaataaagttctggaaggatgcggcattgatacgaatgagtacagcggttttgcgttcggtatcggtattgagcgaattgccatgttaaaatacggcattaacaatatcaagctgctgtttgagtcagatcttcgcgtattaaagcagattgacgattaaagacgaatagaaaaggagagttatcatgttagcaccattaagctggttaaaagattatgtagatattgatgttaccccgaaggaactggaggaaaagttgttttcctgcggctttgaggtggaggagctgattgaagtcggaaaagacatcagcaatgttgtggtcggactggtggaatcctgcgagccgatcccggatacccatttaagtctctgccaggtgaatgccggagagcacggcaccttccagatctgctgcggggcagacaatgtccgtgcaggaggaaaatatccgctggcgcttgtgggcgcaacagtctatgcgaccgcaaaggatcatgtgacgatcgagggcgtcatgacgatcaagaagggaaagcttcgcggctatgaatcctacggtatgctgtgttccggaacagaactcggattgaacgaagatttatatccgggggcaggatacaacggtcttttagttcttccggaagatgcgaaagtcggagcagacgtaaagccgatccttggaatggatgactggatttttgatattgcgatcaccgcaaaccgcccggactgtcagagcatttacggaattgccagggaagtggctgcagtgctcggaaaagagtgcagggagccggcgttggattacacggagacggcggttaaaaaagactttaaggtggaagtagccgcaaaagatctctgcccgcgctatatcgcgcactatgtccatgacgtgacgattggggagtccccggcgtggatgcgcagaagactggcgttagtcggaatcaactcgatttccaacatggtcgacatcacaaactacgtgttaaaagagctcggacagccgatgcatgcatttgactatgcttatctggagggcgatcagatcaatgtcagacgtgcaaacgagggcgagcgcattgtgacgctggatgaaaaagaatttacgctcaattcttccaatcttgtcatctgcgacggcgtaaagccggttgcactggctggtatcatgggcggtctgaactccgagatcaaggacacgacaacggaagtcatgtttgagtccgcaaagttcgcgcgcgacaatatccggaagagttcaagagcgctcggacagtcctccgattccagtgcgatgtacgcaaagggcgtctatgagtacacgacggtcatggcgatgaagcgtgccctgcatcttgtggaagaactgggatgcggaaaagtgtcgtccacacagcttgaagtctccaccggcaattctatcgagccgaaagagatgaaggtcagcgtaaagcgtgtcaacggtgtgctcggcattgaggttccggaggaggacatgctgcgcattttatcggcgcttcagttcgcaccgtccatcgacggggatgaacttaccctgcagattccggcataccgcgaggatatggattcctacccggatgtggcggaggaagtgatccgcatgtacggttatgagcatgtgattccgacctttatgccgacggcaaaagtgaccctgggaggtcttaacttaaagcagaagacggagcttaagatcaagcgggcactctgcgcagcgggcgcttacgagggagtccattactcattcttctccccgtccgatctggatctgttaagactgccggaagacgcgccggagagaaaggcgatcaagctgatcaatccgatcaacgtggatttatccctgatgagaaccacgctggcatccgagatgctgtacgcgatttccagaaaccagaagaagggaattctggagggacgcatttttgagcttggaaatgtctttattccaaaggcactgccgctcacggaatacccggatgagagagagaccctctgtgcgggcgttttcggagaaaaggaatccttctatacactcaagggtctggcggagacggttgcggatgcattaaacgtaagctttacctatgaggcggcggagagaacctttttgcacccgtaccagacggcggagatcttctgtgagggagagcgcgtcggttatctcggaaagctttcctatgagattcaggatgaacttgacatgcgtgtgcctgcctatgtgatggagattgacctcgcggcgcttaagaaatggtatggcaaagagcagattttcactccgcttccgaagtttgcggaggaaaagcgcgattttgcgtttgtggtagataaaaatatcacctgtgcacagattgagaacggcatccgggaagcctgcaaatatgtgacagatgtgaatctgttcgatgtgtatgaaggcatccagcttggaccggacaaaaagagcatggcattctctgttgtatttaccccgcaggaggaagagctcacgggcgagatggtagaaggatttgtgaagaagattttgaaacatctcgaagcaacactggatatcagacttcgtgcgtaagaggagtagttatggacgtaaaagatttttattatgaccttccgcaggaactgatcgcacaggatccgctggaggaccgctcaagctccagactgatggtgcttgacaaggcaaccggagaggtggaacaccgccattttaaggatattgtggactatctaagaccgggtgactgccttgtcatcaacaatacaaaagtaattcctgccagactgtacggcgtgaaggaaggcaccgaggcaaagatcgagatccttctgctcaagagaaaagaaaacgatgtctgggagaccctggtcaaaccgggaaaaaaatgcaagatcggaaccagaatcaatttcggtgagggacttctgaccggcgaggtcattgacattgtggaggaaggcaaccgcctgatccagttccattacgaagggatttttgaggagattctggatcagctcggacagatgccgctgccgccgtacatcacacaccagctgaaggacaagaaccgctaccagacggtgtatgcaaagtatgacggttccgcagcggcgccgacagcgggactgcattttacaccggagcttttagagcaggtgcgcgccatgggcgtggagattgcggaggtgacgcttcatgtgggacttggcaccttccgcccggtcaaggagagtgatgtgttaaaacatcacatgcattccgagttctaccggatcgagcagtcggaggcggacaagatcaaccgggcaaaacaggagggacaccgggttatcgccgtgggaacgacaagcacaaggaccctggaagctgctgcggatgaacacggcgtgcttcatgagacgagtgggtggacggagatttttatctacccgggctatcagttcaaggtgatcgatgctttgattacgaatttccatctgccggagtcgacgctggtgatgttagtgtctgcgcttgcaggaagggaacatgtgctgcatgcatatgagattgcagtacaggagcgttaccggtttttcagctttggtgatgcgatgtttattaccgcaaaataggaggagttggtcccatgctggaaaagagaaaacataagcgccttaagatggaacacgcgctggaactggcgcggttaaatgcggacggcacggccgacggcggcgttgtgaatgcggatatcctgaatatctcgcgcggcggagtcggatttttgtcccgcaagagactcgaggtcggcagttattatgacaccaggatcagcctgttcagccgggagatgattgacgctgtgctggaaatcgtacatgtggaagagcaggaaaagggctattactacggcggagaatttatcggcatatcggattcggatgcggtaaagattgatatttaccaggtctttcacgacatctgaccgtgaaaatagacaaaaagacacgtctgattgtgtgcattatatacgaaatgacgataaaatggtgccacactattgacaatggtgatcattaaatttataattggagacagttaaaggatagttcacaccgcaaggtgcactaaaccggaaagctgaatacaggctatttgggcatgtatgaagttttccggttttcttttttcccaagaggagtctgttgtttgaaagaggagggagtcagatgagaatctatcgggcaaaagattattatgacatgagcagaaaggcagccaacatcatatccgcgcaggtgattatgaagccggactgtgtgctgggacttgcaaccggttcgacgccggtcggcacttatgcacagctcgtggagtggtacaaaaagggggatctggatttttcagaggtaaagacggtgaatctggatgaatataaaggactcgaccagtcgaacgaccagagttatttttacttcatggcggaacatctgtttgacaaggtcaatattgattttcagaatgtcaatatcccaaatggaatggaaacggatgcggacaaggaatgtgcgcgctatgaggcgaagataaaagcgctcggcggagtggatctgcagctgctcggaatcggtcacaacggtcacatcggattcaacgagccgaacggacagttcgaccgcacgacgcactgtgtgaatctgacacagagcacgattgaggccaacaaacggttctttgcatcggaggaggacgtgccgcggcaggcgtacacgatgggaatcaagacgatcatgcaggcgaacaagattctgatggtggcaagcggggaagacaaggcggagattgtaaaacgtgcctttttcggaccgatcacaccggaggtgcctgcatcggtactgcagcttcacaacgatgtgacactggtgggagatgaggcggcgctgtcgctgatcggctcctgtcagagttaggatatgggaatgaaatcatgaagataagtaaagtgattaataacaacgtcctgtcggcatttgatgaaaacgggcaggaagtcgttctcatgggaagaggactcgggtttaaggcgaagacaggagacgacattgacgagagccgggtacagaaagtgttctgcatcgaaaattcggcgctctcaaggcagtttcaggaaatgatctccaacatccctatggagcatatgcagatctcggcggacattatctcctacgccaagaacgagtgcggcatggagttaaaccagagtatttacgttgcgctgacggatcacatcaatttcgcgattgaacgatacaggaatgggattgcgctgtcgaacgctattctgtgggagatacggcagttctaccgcagggagtatctcgtcggagagtatgcgctccgcctttttgcggagagactggatattcatttcccggaggatgaggcgggatttattgcactgcattttgtgaatgccgaatataatacggatatacatgacacttatatgatcacggatgtgattcagaagggaatcgagattgtaaaggcagagtatcagaaagcgctggatgaaaaatccatgcactacgagcggtttgtggcgcatctgaaatttttcgcgagaagaatcttcttcagcaaggaaatgctctccgatgaggagcaggagttctccgatctgattgaactgaaatatccgagggaatatgcgtgtgccagaaaaattgccgattacatcgaagcgcagtatgactgcacggtgaccaaggaagagatcatgtacctggcaattcatatccggagaattacgacagacagcgatgaatgagaaaggagagaggctgatgtttggattatttcataaaaaagaacagaaagcgctggaactgggagcgccggtaagcgggcaggcagtaccgcttcaggaggtgagcgatcccacgttcggcggggagattctcggaaaaggcgtggcggtaagacccacggatggcaggatctacgcgccggcggatggggagattaccttgttatttgatacactgcatgcgctcagcatgacgacggataccggggcagaactgctgctccatattggactggacaccgttgcattaaagggtgcgcattttaaggcgcatgtaaagacgggggataaagtcagaaagggtgatctgctgttggaggcggatcttaaggcgatccgggaagccggatatgatgtgatcacaccgatgattgtctgcaataccgaccattttgccgaagtaaaagcggtgacgggtgcggaggtgacgccgcaggatacggttctgattctcacatcgaagtaatctgttattcaatggtattttaaccggaactttccggtataaaataaaggggcaaatcatatatggcatagggagaaggtctactgtgccagaaaaagaaggaggaagaagttatgatgaaatatcttcagaagttgggaaaagcattgatgcttccggttgcctgtctgccgatctgcggtatcttaatgggaatcggatatgcactctgcccggcaaccatgcagggtggtgacattgcaggtgcaaaggcgctgattggatttttccttgtaaaagcggggggcgctttaattgacaatatggcatggctgtttgtcatcggcgtcggcgttggtatggcagacgacaatgacggtaccgcggcacttgcggcgctggcatcctggctgatgattaccaatctgctctcgacgggcgttgttaccacattgatgccgtcaatcgcagagaatgcggataagacgctggcattcgacaagattgcaaacccgtttatcggtattcttgccggtatcatcggagcaacctgttataacaagttcaagggaacgaagcttccggactggctggcatttttcagcggcaaacgctgtgttgccatcgtatccggtgtggtatcgattgtcgtgtcagctatcctgttattcgtatggccggttgtgttcggcgcactgatcgctcttggtcaggcaattgtgggaatggatgcagtgggcgctggtatctacgcatttttgaaccgtcttttaattccaaccggtctgcatcatgcattgaacaacgtattctggtttgatacgatcggactcggtgatctggccaacttctggaagggcaagacatcggcggatgtatcatgggatctcggtatgtatatgtccgggttcttcccgtgtatgatgtttggtattccgggtgcggcacttgccatggttcacacggcaaagagcaataagaaaaagatcgcaatcggattggttggttccgcagcactttgttcattcatctgtggcgttactgagccgttcgagttcggattcatgttccttgctccggcactctatgtagtatatgcattattatacggtatttttacctttatcacggttctggtaggcttccgtgcaggcttcagtttttctgcaggtgcaaccgacctgatcttttccgcttcccttccggcggcaaagaacacctggatgattcttccgctcggaatcgcagcatttgtcgtattctatgttgtattccgttttatgatcacgaagtttgatttaaagactccgggacgtgaagatgacgatgatgatgcagagaaaggtgcaaagcttgagaataatgattacaccgaagtggcaagaatcgtgcttgaaggtgtcggtggcaaagagaatatagaaagcattgataactgcattacgagactccgtctggagatcagggattacactaaggtagatgagaaaaagatcaaatctgccggtgtggcaggtgtggttcgcccaagccagaaaacagtacaggtcattatcggtacccaggtacagtttgtggctgatgaatttaaaaaactttgtaagtaaccatattctgtaaaatagattgccccaatgaaaaacgaccgcgaaagcggtcgtttttcgatgcagacatatattcagcgctcataaatggtgtagtggtgcttttttagaagtgtgatggcggcggcgagcgattcgctgtcgtacatttccagatgcagcacgccgtcctcaaattcacggttgtggatgatgccgatattcttgatgctcaaatggttgctagcaagaatggtggcaactgtggcaattccgcccgcttcatccagaagatccatgtacagctcatatacctgctttaaggtgccgttcgcgtgaagggtcagggaatcccggtagtcttttgccgaggtaaaggcctccatcagcgctttgctgtcggaagcggcgatggcagagcgcatatgaccaagctccccacagaaagagtcaatcagtcttagaatctgttcctgattggaaagacagatattttcccacatgacgggggaggaggaggcaatgcgtgtaatgtccttaaagccgccggcggcgatggttttcatggttccttcacagtcatcgcagcttttcacaaggttgacaaggctgtaggcgatgatgtggggcagatggctgatggcggcagtggcataatcgtgctgctcgtagtcaagcaccatcggtatcgcaccgagagaagccacaagctccttaaagtcttttaatgccgcgggatcggtctgggcggtcggggtgagaatatagtaagcattttccaataaaaattccctggcattggcaagaccggtcttctcggagcctgccatcggatgtccgccgataaactgcgcctccatgccgagggcggtcacttcccggtgaatgtcggtcttgacgctgcccacatcggtaatgatgcagcggtcgcagacgtgtccctttaaaagacgcagatattccatgtttttctggacaggcgtgcacagaaaaatatagtcgcagtcatagaaatccgacagttcacaggggctggcgttgtcggtcagtccctctttgtaagcggcctctatcgtcgcggcatgaccggctgtagcgataatgaccagatctttatgtagaatacgaaggcgcttggcaatcgaaccgccgatcagtccaagcccgataaatccgattttctgaagtttcataaatgaatcccccacaagttattggtacccaattatcatagacatttccgcctggaaagtcaacacgttaatctgtgagagtacggaaagatgcggcgtgtatggcgagaacatgtccaaattgtaaatattgtgtaaataataaaaagaagtattccaaaaatgttcaaaagtaatacatattattgctaaatgtttctgatattataaatacagttagtaatattgaataaataagttgtaaaaaaagacggaatttagtaaaatatatccatacataaaacaattacagaatatggagggtttgctatgaatgtttacacaactgacagaattcgtaatgtggttttacttggtcatgggggatgtggtaagacgagtcttgtggaagcaatggcttatctggcaggcatgacatcacgtatgggaaaggttgaggacggaaataccatcagtgattatgacaaggaggagatgaagcggcatttctccatcaatacttcggttgttccgattatctgggaagataccaagatcaacatactggatacaccggggtattttgattttgtgggtgagaccgaggaggcggtaagtgcagctgacgcggcgatcatcgtggtttccggcaaggcgggtattgaggtcggcacgcgcaaggcgtgggaattatgtgagcagtataagctcccgcgcatggtttttgtgacagatatggatatcgatgaggcgagctaccgccaggtggtacaggatctgcaggaactctacggaaaaaagatcgcaccgttccatctgccgatccgtgagaacggacagttcgtcggctacgtcaacgtgctgcagcagcgggcgaagcgctggaaggagaacggcgaggttgagaagacggacgttccggattattcaaaggagaatcttggcatctgcagagaggctctgatggaggcggttgcagagacgagcgaggagttcatggaccgctattttggcggtgaggaattctctgaggatgagatccgacaggcactgcgtgtgaatgtggcggagggaagcatcgttccggtgcttatgggttccaatattttggcacgcggcatctacacgctgctggtggacattgtgaaatatctgccaagcccggaaaagcgcacctgcaccggcatcaatgccaagaccaatgaggtttacaatgcggattacgatttcgcaaaggcaaaatccgcctatatctggaaaacaatcgcagatccttttattggaaaatattcccttattaaagtcaattccggcgtgttaaagacggacgacatcttattcaatcagcataaggatgtggaggaaaaagtaggaaagctctacgtgatgcggggcaacaagccggaggaggtaaaggagctgcacgcgggcgacattggtgccctggcaaagctttccggtgcgacgacgaccgattctctctccacaaaggcgaatccgattctgtatattagaacaaccatctccacaccctatacctgcaagcgctacaaggcgaagaacaagggtgatgaggataagatctcgcaggcattgcagaagctgatgctggaggatctgacattaaaagctgtcaatgacagcgagaacggacagacgcttttatacggcatgggcgatcagcatctggaggttgcggcgagcaagctcttcgagcgctacaaagttgagatcgaattaaaacgtccgaaagtggcgttccgcgagaccatccgcaagaaagtcgatgtggagtataaatacaaaaagcagtccggcggacatggacagtacggtcacgtaaagatgacatttgaaccttccggagatctggaacagccgtatgtatttgaacagtgtgttgtcggcggcgcggtgccgaagaattacttcccggcagtcgaaaagggcgtacaggaagcggtattaaaaggacctgtggcagcgtatccggttgtcggagtgaaggcggttctctacgacggcagcttccatccggtagattcctccgagatggcattcaaggtagcggcgatgcaggcatttaaaaaaggttttatggacgcatccccgatcctgttggagccgattgcctccctcaaggtggttgtgccggataagtacaccggcgatattatgggagacttaaacaagagacgcggccgcgtgctcggcatgaatccgacggagcacggttatcaggagatcatcgcggacgttccggtgatggaactttacgggtacaacacagacctgcgttccatgacaggcggaagcggaacattttcttatgaatttgcacggtatgagcaggcaccttccgatgtacaggagaaggagatcgaggcaagggcatccaaggtagaacgtgcggaagagtaacagcagtatgtaaaagcagcagaaaagagtaataggcagaaaagaaaggaggatgagcagagatgagaaaagaacttcttgcactggtatcgatgtttgtcctccttttgaatgatccgatggtggcacaggcttacatgatggttccgacggatggcacaggatgggagcagggcgggacggcttcgattgatccgttcctcggcgtgaacgatgacgctgtgcatctggtgtatgagttaaacggcggtgtgaaccacaatgccaacctggatgtgatcgcagtggaagaacttccctttacgcttgagattcctgtccgggacgggtataattttgccggctggtatacggacagctcctacgatcacaagatcacggagatcacggaagaaaatgcagcgaatatggttctgtttgcaaaatggaccagaccgatcgacaaccgctataacgtcgagatgtattcctatcagaccgcgagcgtgttaagccgcaatcaaaaagaattaaaagagtgcaattatgcgtttctggatgatctggatattccgggaatgccgtccaccagagagaaagactatctcgacaatctgatcagcagcgagggacagtgtctgcagggactctgcttcacaccggattacattcttatgacggcgtatgcggatggatccgacacgaaaggctccttaatgatctttgagcgtgagaccggaacctatctggcgacgcttggcatgaaggagaagagccacctcggcggaattgcctttgacggggagaatgtatggatctgccattccaattcaaagacgctggagcggattccatatgaatatattgagagaatcggagccgatgcacccggatactgtgtggacgcatctgcactttccgacgaatacaagctcgacaatattccgtcctgcatcacctgctacggcgggcgaatctgggtggcaacccacaccaaattctttgattccgagatgctttcctacagctacgatgaggaaaatgatacgcttacctcactcagcagctacaatattccgaacaaagtgcagggaattgcctttgacaaaggcggtcaagtatatctgagcacatcttttggacgcaacagttcctcctacctgaaagtatacgcatcgcttctgacgctgacgaagcatcccaatgagccgtcggcaaaggtagagatgccgccatgctcggaggagatcgcaattgcggatgataatgtgtatgtgttatttgaatctgcaagcctgcgttattttgagggaaccgacggcaagggcaacagcagctcgccgattgacaaggtgctggaagtgacggtggcgtcgatctggtaaaaaatagaagaacagcacagaaggagcggttttaagagccgctccttctgtttttcattaggttcatgattttgtcagctttggcagattcttctgcggacatgttctgctttaggatctggaataagagatccgtctccggttcactgaactggatgttatttgattttgcggaattcatggcagagagcagaaacggcatcatctccttgatgtcggtcggctttttggcggtggcaaagttcatgagaaactgtagcttctccggagacatatcggcgagaagcggattgttgttcaaaaaatcgtagggcataggaattcctttctgtttaactgaagatggtttcgtaggtctcaagcatggagaacatattcgcaagcatgtcgatggtttcctgctctttgctggtgcagaaagcgcgcagatcgtttaacatggcaaccatattattgctgccctcatcgacggagcacatggacatcaccttgtcatcctgcgagaacacctggacggtgttttgcagctccatatattttatcaatatggcaaattgctttttttgtgtatctttcatgtaggggagcatggtttttaacatctgcagttcccgtgtctgtgtcatataatcaaacggtgtaaaagtggatgtttcgttatgatccataagaaccctttttcttttagtttatgagcagagaagagactttatgaccggtaacgcatatcatataatgtgggcaaaggcaaaaggaagcatggaataaaagaggcaggacttttgccggagcgcaatcatatacgcgtctgtggaatggagattggtatgcttataatagaaggtaacagtgtatacgagattgatgaggaatgtgtgcgaaaaagaaaagtccctgaaaaatgccagacggcacagaaattgcagatgcagagaaaacgggatgcggagagcggtcttgagaaaaagagcgaacgctagaataataaaaatgaggagcggcaaatgccgctcccttttagaatccgtgtgcgtttttattagcagcagccgaatccgttgccgttgccgtttccgcatccgccgcagcagaagagaagcaggataatccaaaggcagctgtcatttccacagccattgccggaattaagaccgcagccgttgccaccgcagcagcacagcaataagatgatccagagaatggaaccgcatccgccctcgttacaggaacatccaccaccacagtttgtcgcagctaaatcactcatattaaatcctccaaatttttcttacactgtatcttatggcatccggaaagatttgttacaaatttttctaaaacaattgttatgcgttctctaatttgctatgatgaacgtagcaaaacagagccagatggcgggagggatgaacatgggatttgttgtaattgcggaaccggatgaagtaaatgcggcgcgcattaagacgatattagacagtctggacaaggatttttcctatgcacttgtcggttcagcggaagcagcgatacagcttgtggagcagaataccaccgatgtgtttatcgcggatatgcagatgccggtgattaagggaacagaactgttttcaatgattgagatgatgtctccggagacaatacggatcgtgatgactgacggcgcacggattgcagatactgtggcatttatgaatgaatgccgtacctttaagattatcatcaagccgtgccgtgtggcagatgacctcatggctccgatccgtgcagcctttcggtataaggaacagctggagcgggctgccggacaggagcaggaacaggagactgcgtacagcatgacggagcaggcgtatctggagcaccgcaggatgtggctgatgcgggcaagcaacaataagagagcgcaggacgtgctggcggaactgatgaaggtgaacctttctttttcagatatggaagcagaacgaaaggaacgcctcggacgctggtatgtctggattgtatccgaatacatcaactgtgtttcgtgcgggactggcgagtttaagaccgcagccgaggggcttgcggcattcggcaataaaccggaacagcaggaatattttgaattgaggtgcactgccgatgaggtggtcgacccggaacggatgaacgaggtcacttatattctgcggattattaccggactgtgtaaggatatcttaaacggctatcggatcatggcaatcctggagccgatggaaaaggtctatgtgcttcgtgtgcgcatacagatgtataaagattcattcagaattaaaaatacaacaatgcgggagggattgtcacgcgcaacggaacttgcgatcgacgcgctcggatacaaatctgtcgtcatgaacaaggagcaggagacgatttttaatctggcattacggcgctgaatgtcataatgtctgccattactataacaaagcattatatctgctataactttttattcattgacaaatagaacaagaaatgtatagtataagaagacggtataattgtatacaattatgcaagcggttatttatgcaatgatcaagaaagattatacgacggagagaagccgtgaaggaaccgccgcattggatgatggcaaaaggagtgcagctatgagagaagtcgtaatgaataagaaaacgaacctgctacagttggaagagcatttttatcagctcgtggatgtggaagagccgaacgtattccacaatctgttcccgtacagtgagataccgaagatcgcattcaatgatcgtattgtcccgcacaacatgccggagaatatctggattaccgacacgacgtttcgggacggtcagcagtcgagagctccttatacaacggagcagattgtaacgatctatgactatctgcataagctgggcggtccgaaaggactggtccgtcagagtgaatttttcctatatagcaagaaggacagggatgcggtctacaagtgcctggaaagaggatacaagttcccggaggttacgagctggatccgtgcaagcaagcaggatttccagctggtgaaggacatcggactcagagagaccggtattctggtaagctgctcggattatcatattttttataagatgaagatgaccagacgtgaggtcatgaatctgtacctgagcgtgatccgcgagtgcctggagacgggaatcagtccgcgctgccatctggaggacattacgaggtcggatatttacgggtttgtcattccgttctgtgtggaactgatgaagctgatggatgagtacaagatcccgatcaagatccgcgcgtgcgataccatgggatacggcgtgaatttcccgggtgccgtgatcccacggagcgtgccaggtattatttacggactgaccacccatgccggcgttccgtcggagttgattgagtggcatggccacaatgatttttacaaggcggtcaataactccacaaccgcatggctttacggcgcaagcggcgttaactgctccctgttcggtatcggagagcgcaccggaaatacaccgcttgaggcgatggtctttgagtatgcgcagttaaagggaacacttgacggtatggatacaacggtcattacagaactggcagaatactttgaaaaagaactcggctatgtacagccgagccgcacaccgtttgtcggaagcaactttaatgtgacgagagcgggaattcatgcagatggactgctcaagaacgaggagatttacaacatttttgatacggggaaattcttaaacagaccgcctcttgtatcggtgtccaacacatcgggtcttgccggaattgcacactggatcaattcgtactatcatctgccgaaggagaaatgggtcgataagaattcggatctggttaagaaaataaaagtctgggtggatgcacagtatgaggacggacgtgtgacggtacttacggattccgaacttgtggaagagatcggaaagtgctgcaaagagctgaacatcacgatatagcatgaggtaaatagatgagtgaggataattattcgctgagttcgcgcgtgtttcacacaatacgtgaaaatatactgtccgggaaatatgcgacggacgaggaattaaaagaaaaatccatcggagaggaactgggtgtcagccggactccggtcagggaggcactgcgccagctggaactggagggtcttgtgaccatcattccgaacaagggagcatatgtcgtcggaatctcccagaaggatatccgcgatatttatgagatccgctccaggctggagggactctgcgcgaggtgggcgtgcgataacatcacaaaggatcagctggatgagctggaggagaacatttatctgtccgatttccactcgtccaagggaaattccgagcaggtggtggagcttgacaacaagttccatgaaattttatacgatgcgtcaggcagcaaggagctgcgccacatcctgagggattttcaccactatgtgcagcgcgtgcgcaaggtgacgctcgccgtgcaggagagagcggtcaattcaaatgaggagcaccgcaagattgtggaggcgctaaagcagcatgacggggccagggcggaagaactggcggacgcacatatgcgcaacaccattaacaatatggatcattacggctgggacaatctgctcaagcagtaagagcggaagatgccatgtcagatagaacagaatcacagcacagaaaggaagcagccatggaaaaaatcaaaatgacaacgccacttgtagagatggacggagatgagatgacacggattctctggaaaatgatcaaagacgaactgttgtatccgtttatcgatcttaagacggagtattatgatctcggactggaacaccgcaatgagacggacgatcaggttaccgtagattctgcaaatgcaacgaaaaagtacggggttgctgtaaaatgtgcgacgatcacgccgaatgccgcccgtatgacggagtatcatctcaaggagatgtggaagagcccgaacggaacaatccgcgccatgctggacggaacggtgttccgtgcaccgattattgtcaaggggatcgagccgtgcgtgaagaactggaaaaagccgatcacgatcgcgagacatgcatacggcgacgtctataaggcgagcgagatgaagattccgggaccgggcaaatgcgaactggtctacacggcggaggacggaaccgagacaagagagctgatccacaattttaccggtgcgggcgtggtgcagggacagcacaacctctgcaattccatcgagagctttgcgagaagctgctttaactatgcgcttgacacaaagcaggatctgtggtttgcaaccaaggataccatctccaaaaaatacgaccacaccttcaaggatattttccaggagatttatgacagcgagtatgcgcagaagttcaaagatgccggaatcacatatttctacacactgattgatgacgcggtggcgcgtgtgatgaagtcggagggcggctatatctgggcgtgcaagaactatgacggcgatgtgatgagcgatatggtatccagcgcgttcggttcgctggcaatgatgacctccgtgcttgtcacaccggacggaaagtacgagtacgaggcggcgcacggaaccgtacagcgccattactataagcatctgaagggggaggagacctccacgaactccgtcgcaaccatttttgcatggacgggcgcactcagaaagcgcggagaactggacggcagtcacgagctggaagagtttgccgacaagctggaaaaagcttgtgttaagaccatcgaggatggtaaaatgacaaaagaccttgcgctgatcacaaccatttctaatccggttgtattaaacagtgaagattttatcaaggcaattcgcagcacgttagaaggaatgttattgttatgattttatcctgtcagaatatttccaagtcattcgggacagacgaaattctcaaaaatgtaagttttcatatcgaagcaaatgaaaaagcagcgattgtcggcatcaatggtgccggcaagtctacgctacttaaaattattatgcagaaagagacgccggataccggtgaggtgatccttgcaaaagacgccaccatcggctatctggcgcagtatcaggatgtgtccgggcaccggaccatctacgaggaagtccttgacgcaaagaagaacatcatcgagatggaggagcgtctccgcgggatggaggcgcagatgaatgcgctcacagggcaggagcttgaagcgcttctggacgggtatcaccggttgagccacgagtttgaactgctgggcggctatacctaccgcagtgaagtgacgggaatcttaaagggacttggctttgtggagagtgaatttgaccggcagatgagcgaactttccggcggacagaagacgcgcgtgtcactgggcaagctccttgtgacaaagccggatgtcctgcttttagacgagccgaccaaccatctggatatggaatcgatccagtggctggagggatttttgatgaactataagggagcggtcgtgatcgtgtcgcatgaccgctattttctggaccgcgtcgtcaccaaagtggtggagattttccagcatcaggggtatgtctaccagggaaattacacggaatttgcgaagaaaaaggcgaagatccgggaagatctgttaaagcagtattacaaccagcagcgggagattaagcaccaggaagaggtcatcacaaagctcaagtcttttaaccgcgagaaatcgattaagcgggcggagagccgtgaaaagatgctggataagatcgagcgtctcgaaaagccgacggatgagaacacggacatccatattgtgctcgagccggatgtgacaagcggtaatgatgttcttacggtggagcatttaaggaaagcgttcggaacacatacgctgtttgacgatctctcttttgagattaagcgtggggagcgcgtggcgctgatcggcaataacggaaccggcaagacgacgattcttaagatcatcaacgaactgcttctggcggacggcggaaccatcgtgctcgggtcgaatgtgcacatcgggtactacgatcaggaacatcagctgctccatatggagaaaacgatctttgaggagattgcggatgactatccgcagttaaaccacacgaagatccgcaatgtcctggcggcgtttttatttacgaacgatgatgtattcaagcggattgcagacttaagcggtggggagcgcgggcgcgtctcccttgccaaactgatgctttccgatgcgaattttctgattctggatgagccgaccaaccatctggacatcacatccaaagagattttggagtcggcgttaaaccagtacaccggaaccgtctttttcgtgtcgcacgaccgttattttatcaatcagaccgcaacccggattctggatttgacgggagggacgattgtcaactatatcgggaattacgattactatctggaaaaacatgacgagctgacccggatctatgtggaggcggagccgaaggcgcaggcggcgcagatgacggaacagaccgtggcgcaggacggaagtggaacagacaagaaagcggactggcagacgcagaaagccgagcaggcgcgcatccgcaagcttgagaatacgctaaagaaggcggaagagcgcattgccgagctggaggatctgatcgccggcattgatgaggagtgcgcagatcctgccaatgcaaccaattccgcgaagctcggcgagctgaccggcagacagaatgaataccggagcgagctggaaaaatgctacgaggaatgggagcaggtatcgatggagcttgagtcgtgagggatgccgtctggttgttaaatttttgacacattgacagatatctggtttatcactataataaaagagatgttttgatagaaaggtgggcatcaccatgcaggaaaaagaaatatcacaggctgtcattcgtcgaatgccgcggtattacagatatctgggagaattgctggacgccggggtagaacgtatttcttcaaatgatctgagcctcaggatgaatgtcaccgcatcccagattcgtcaggatctcaataattttgggggatttggccagcagggatatggatataacgtaaaatacctatatgaggaaatcggcaagattctaggactgaaccagcagcacaatattatcgtgatcggtgccggaaatctcgggcaggcactcgccaattacgtgaagtttgaaaagcttggatttatgatcatcggactgttcgatgtcaatccggcgttggacggtgtgactgtgcgcgggatcaagatccgtatgctggatgagctggaagatttctgtagagagaacaaagtagacattgcagcgcttaccatgccgaaggaaaaagcggacgccattgccaaccgtctggtcggtcttggcattcatgcgatctggaattttgcacatgtggatctggaattgatcaataaggacgttgttgtggaaaatgtccatctctcggacagcctgatgcagttatcctacaatattgtgaagaatcagcgcgccaaagagaacagccgtcagacagattaaaagaggtcctgcatagcaggatctcttttttactctatagggaactttgttccagtgttttactgaaataaaatgccgggtgtgatgccggcaggcgggagggaaaagatgcgatatatcgtaaacagccgggagatgaatctttatgacagccggacaatcgaggaatttcatatgccgcaggcagtgttgatggagcgggcggcgttttcctttgtggagacactgcgccgggaaaaacggaatacgtcaagaacactcgtcgtctgcggcagcggcaacaacggcggagacggctatgcgatcgccagaatactcatgcaggcgggaaacaccgtcgatgtattggaagcgccgcacacaggaaaagcgtccgtcggcaatcagctccagaagaagatctttcttgcgtacggcggtaagatcctcacggaatttccggaggggaagtcctacacgctcgtgatcgacgcggtattcggcgtgggattatcgcgcagtgtggagggagaatacgcatcgttaatcgaccggatgaatgccatggaaggggcgaaggcggcggttgacattgcttccggcatttcggcggacaatggaaatgtgctgggaaccgctttccgggcagatctgacggtcacattcgcgtttgaaaaggtgggatgcctgctgtggccgggcaatcagtacgccgggaaagtcgttgtggcggatatcgggattacgccggatgcattcggggagcgcaaaccggcggtggcagcgttagaagacgcggatctgtcccttcttgccgcaagggagagccactccaacaagggaacgttcggcagacttctcgtgattgccggaagccagggaatgtccggagcggcatatctttgcgcgaaagccgcatatgcaagcggctgcgggctggtgcgcatttttacaccggaggaaaaccgcgccattttacagacgcagcttccggaggcggtaatcacggcatattcctccaaaaaggcggaggcgccgcagcttttggaggcaatgagctgggcggacacgatcgtgtgcggaccggggatcggcacgccggatacggctgcggggatggttcgcacagtgatcaagaatgcggcggttccggtgcttttggatgcggacgcgctgaatgtgattgcaaaagatacaaacctgctgcttctgccgcacacggaactcgtggtgacgccgcaccttggagagatgagccggctgacgggggattcggtggcgtatctgcagaatcatctgattgaggcggcggatgaattcgcaagacagtataatgtgatctgcgtcttgaaggacgaacacacggctaccgcgattccgtacagccagacatggctgaatgtatccggcaatgccgggcttgcaacggcgggaagcggggatgtcttaagcggtatcatcggcggactgatggcgcagggaatccgtgtggagcaggcggcgccgctcggcgtctacctgcacggaaaggcgggcgaagcggcaggtgcgcggcgctccatgcgcggcatgacggcatcggacattcatgacggaatgtgcgagatcctggccggactggaacagacgcagtcacagccgggaaaagatggcatatcatagtgttgggaaaataaaaacaaaatggaatacacccgtgaaaaatggcaatactatccgtaaaagatccagagagaaatggagtggaaagtatggtaattcgacgtggggatatcttttatgcagacttgcgaccggtggtcggctcggaacagggcggtgtgcggccggtgctcatcatacagaacgatgttggaaacagacacagtccgacggtcatctgcgcggcaatcacatcgcagatgaataaagcaaagcttccaacacatgtggagcttgacagccagaaatatgcgctggtcaaggattccgtggtgctgttggaacaactgcggacgatcgataagacgagactgaaagataaagtgtgccatctggatcaccagatccttgtgaaaatagacaaggcgctggagatcagtctggaactctatacataacttgactattatgcgcgaaaatgttatgatttctgatgttttagtgtgtaataccggagacacgaaagaaaggatactatatggatgatggttgcagccccactgtgggcatcctcatttttgcaggatttgtcatattagattttgtggtttttggctttatcgccgccatgcagaatttgaatgaggctgccatagaacgtctggcgggagaggaagaccgcggtgcgagacttctgcggcgctatacggataagaatgaacgatatacgcatgtctgcgaactggtggttttaatcgtgcatatgctgctcggttttctggaggtaccgctctggcgcgcgtattttctgccggaagatgtgggaagcgtcatgtcggtacttgtggatgtcctcatttttgtgatcctgattctcattgtgctggtgtttggaatctacacgccgcagaaagtggcgtccagaaagccggaagcctgggcactgcgtctggcgggaccggtacatgtggtggagcttcttttttacccgatcatattcctgacggacggtttagccaaccttctggcgcgcgtgttcggcgttgatccgttaagcgatacggatgatgtgacggaggaagagattatctccatggtaaacgagggtcacgagcagggtgtgctccttgcaagcgaggcggagatgattcataacatctttgagtttggcgacaaggaagccaaggatatcatgacgcaccgcaagaatatctgtgcgctcgacggaaccagaacgtttcgacaggccctggagttcatcaaggagaacaactattccagattcccggtgtttctggacgacatcgataacattatcggtgtcctacatatcaaggaggctctggaactgagcctggatgcggcggtttatgacacgccggtctctaagatcaagggtctgatccgcgaggtggacttcatccccgagacgcgcaacatcaattccctgtttgccatgatgcaggcagccaaaagtcatctggtgatcgtggtggatgagtacggacagacggcaggcattgttgcgatggaagacattctggaagagattgttggaaacatcgaggacgagcacgacgaggagacgaacatggtcgaactgcagccggatggaagctatctgatgagcggtatggctccgtttgacgaggttgtggaagtgctgggaattccgctggatgaagaggacgatttcgagacgttaaacggttttttgatctcactgatcgataagattcccagcgacgacgaggtgttttcaacaaccgcatacgggtatctgtttgagatcctttctgtagagaacaagatgatccagaaggtacacgtgatcaaacttccggaggagaaggcttcggaagtcgaactggcagacgggacttgccagaatgaagaataaatgttaaaataataaaccggatttcaacagaaaagaggaaaaaacatgtcaggacattcaaaatttgccaacattaagcacaagaaagaaaaaaatgatgcggcaaagggaaagatttttaccattatcggaagagagattgctgttgcagtaaaagagggcggtcctgaccctgccaacaacttcaagctggcacaggtcatcgccaaggcaagatccaacaatatgccgaacgatacgatcgagcgcggtatcaagaaggctgctggagacggcaactcggtcaattacgaattctgtacttatgaaggctacggtccgagcggaaccgccatcatcgtaaagtgcctgacggacaataagaaccgtacggctgcgaatgtgcgcaacgcgtttacaaagggacacggcagtatcggtacacagggctgtgtatcttatatgtttgatgagaagggacagattattgtcgcaaaggaagattacgagggagatgcggatgagctgatgatgcaggctcttgacgcaggagctgaggatttttccgaggaggaagacagctacgagatccttacagcgccggacgattttgaggatgtccgcagagcgttggaggatgcaggtattccgatggcagaagcttctgtgaccatgcttccgcagaactatgtggagctaacagcggaggaggatctgaccaacatcaaccgtattctggatcttctggatgcagatgatgatgtgcaggaagtatttcacaactgggatgaataataaatttacaaagagagggcagaccataacagatggtttgtcctttttttgtaaaacgctggaattgtagggtgaaatggtatatcataatattgtatatgctttctgcgaaaaacaggatgtttccgatacaaggaggtttttatgaaaaaaatactttttgcagcttctgagtgcgttccgtttatcaagaccgggggacttgcggacgtctgcggcgcgcttcccaaggaatttgacaaggaagagtgggatgtgcgggtggttattccgaattatagctgtattccggaaaaataccgcagccagtttgagtatgtgacgcatttttatatgagcgccgggacttatatccaggacaagtacgtcggggttcttcagtatgtgcttgatggcatcacctactattttatcgataatcaggaatactttaactgcatcgtgccttatggggacatccggtttgacattgagaagttctgtttttttgacaaggcggtactctccattttaaaacagatcaatttccggccggatctgattcactgtcacgactgggagacgggactgattccggtttatctgaaaaatgagttccaggcggactccttttactggggcatcaagtcggtcatcacgatccacaacttaaagttccagggaatctgggacatgaagacaatgcagggactgaccggtttctcggcggatctgtttacgccggataagctggagttccagaaggacgccaacatgttaaagggtggactggtgtatgcggattacatcacgaccgtcagcgattcctatgcgaatgagattcagacggagtattacggggaagggttaaacggtctgctctcggcaagacattacgacatgcagggaattgtaaacggaatcgactatacggtttacaatccgaagacggatccaaagatctatgtcaattacgacgccgcagatttccgcaagaaaaagccgtccaataagatgaagctgcaggaggaactgggacttgccgtcgacaagaaaaaatacatgatcggcctgatctcaagactgacggaccagaagggactcgatctcatcaattacgcgatcgaccgcattgtggacgactatacgcagttcgtggtcatcggaaccggtgatccgcagtacgagaatatgttccgccactatgcatggaagtacggcgaccgtgtctcggcgaatatctgctactcggacgaacttgcccacaagctgtacgcggctgcggacgcgttcttaatgccgtcgcggtttgaaccgtgtggactgacgcagttaatctctttccgttacggcacggtgccgatcgtgcgtgagacgggcggactccgggataccgtaaagccgtacaatgagtacgagaacaccggagacggattctcgtttgcaaactataacggagacgagatgttaggcgtgatcaactactccaaacatatctattttgaccgcaagaagcagtggaaccagatgattgaccgcggaatggcaaacgactattcctggaacaattccaggggacgctatgagggattgtaccgctatcttctgggagaagtgtagcgtgaactgacataatatgacgctggatgatacatactaagcagggtgcaattttgcaccctgcatttttatgcaattagtaaaaagagaagaccgaaggagaaggagaaactatgtcagaaaaacaggaacagaaaaatgaggatatccgggaattcggacaggttgcgttaaataacaaccgggagaacaaccggatctcacttttaacgattataggagagattgagggacacgattgtctgccggcgacgactaagacaaccaagtacgaacacgtgcttccgaagctggcggagatggaggacaaccgggatacggaaggaatcctgctgctcttaaatacagtcggcggcgacgttgagagcggactcgccattgcagagatgattgcgtcgatcagcaaaccgacggtatcgctcgtgctcggaggaagccattcgatcggcgtgccgctcgctgtctccacggattactcgtttattgtcccgtcgggcaccatggtgattcatcccgtgcgcatgagcggaactgtcataggagccaagccgacctacgattattttaaacagatgcagaaccggattttaacctttatcgcgtcgcattcaaaggcgggggaagagcgtctggaggaactgatgatgaacacgggaatgctgacaaaagaccttggaaccattttagtcggggaggaagcggttcgggaagggctgatcgatgccgtgggcggaatcgatgccgcgtttttaaaactgcatgcgatgattgatgccgcaaagggaaaaaattattaagaaaccttttaatgacaaccgccctcaaatatgttaaaattggtcatgtatgtataagtttgacagatttttacgaatcggataaggaggctgccatgtcattattacaggcgatcttgatgggcattatacagggactgaccgagtttttgccggtgagcagttccgggcatctggcactttttaaaatactgtttgatgtcaataccgacacgggaattttatatgatgtactgcttcacgtcggtacattgattgcaatctccctggtatactaccgggacatcttaaaactggtggtagatggatgctgcatcatccgcgacgccggatacaatgtgattgtcttcttccggaataagaccggcaaagagcagatggcgtatcgacgcgtgatcaacagcagctaccgcaaatttgccatgctgattatcgtatcgacaataccgactggaattatcggctatttctgcaaggatgtcgtggagatggcttccgagattctgattgttccaggcatctgccttatcgcaacggcagtgttgcttttgatcgcggatcactgcaaggacggcgacaaacttccgaaaaacgtcacctacacggatgcgttttctgtcggaatcgcacagggaatcgcaacgcttccgggactttcacgctccggtacgacgattaccgcctgcctgcttgcgggttatcagcgcaattttgccgtgaaatactcgtttttgatgtcgataccggcgattcttggcgcgcttgttctcgaattaaaggatgccacagacctggcggtgtcgggaacggaggttgtctactatgtgatcggtatggcggtcgcggcggttgtgggatatgtctgcattaagacgatgcttgtcatcgtccgcaaaaagaagttcactgtttttgccatctactgtctgctcgttggcgcattgtccatcggcgggtatttttatctggcataacggttttggaggttagtaagttttggcaacagggaataaaaagagtacatctgggaaacgaaaggcacagacaagccggaagggaagtacaggacggaagaaaaagacggctgcacagcagcaggaggattttaccagggaggtcattctctggatcattgtagcggtatctattttattatttatcagtaatttcggaatcgggggaaccatcggcaatgcagtgagcaggttcttttttggcgtcatgggactgatcgcgtatgtgttcccggtgcttcttcttgtcggtactttttttgccgtgtcgaacaggggcaaccgggtggcaaccgtaaagcttgtggcgatgattctgtttgatctgttcttatgtatgctgatcgaactgctgaccaaagggtctgcggttgacggtgccgctgcggcatacagctacagttttgagcaccggacgggaggcggcttcatcggcggacttctggcatggattttctgcccgaatttcggtctggctggttcttatgtgatcgatgcgatcatgttaatcatatcgctggtgttaattacagagcgctctgcgcttcgcggaatgcaaaaaggcgggaaaaaggtctacgaatccgcgcgcagcggaaatgaacgccataaggaacgcgtgagaatccagcgggaagagcgggagcagcgcagagaggaacaggcattaaggcggatggatcgcaaggtggaaggggttgccattgacacccgggtgctgccgcggcagaatgtcattgaacattccgatgagatcagtgaactgaatgcggaggattatctggagatgccggaggtacgggaagaaaagattgtgcctctcacgtcggacggcggatatccgcctgcagagaatctgacgccgtcggcgttctcagacgaagcgcttgcggctgtgacaccggaggcttcacagaacatatctgcatggactccggaaacggagactgcacagggagcatcctggaatactgcgccggcggaagcatcgtgggatgtggcaacagagccggaagatccatggagcactacagcctcgcaggaacagaaagatccgtggagcagcgcagccgaaccggaagatccgtggagcactgcatctgcgcaggaacagaaagaatcatggggcagtgcggccggaccagaaaacgcatgggaggcggctgcgccgaaagtacagctgaaagagccgcaggaagcatcggcagccgtatcgcccgcagagacaaaggctgtgtccggcatcggggaaaatgccggacataccacatctgcacctgcggcatccggtgaaagtgtgtcggcggagcagatgcctccggagcgtccgtatgtgttccctccggcagatcttctgacaaaggcggcaaacaaagccggggattccagacagcatctgcaggagacggcgatgaagctgcagcagaccttaaagaatttcggcgtgaatgtcacgattaccaacatcagctgcggtcctgccgtgacgcgctatgaactgcagccggagatgggagtaaaggtcagcaagattgtcaatctggccgacgacatcaagctgaatctggcagcggcggatattcgtatcgaggcaccgatccccggaaaggcggcgatcggtattgaggttccgaacaaagaaaacgtcatggtttcttttagagaactggtagagtcggaagaatttaaaaagcatccgtcaaagatttctttcggcgtcggaaaggacatcggcggaaaggtgacggtggcggacattgccaagatgccgcatcttctgattgccggtgcgacgggttccggtaagtccgtatgtatcaacacgattatcatgagcatcctctacaaggcgaaccccaaagaggtcaagctgattatgattgatccgaaggttgtggaactgagtgtctataacggcatcccgcacctgatgataccggtggtcaccgatccgaaaaaagcggcgggtgcactgcactgggcggtggatgagatgacagaccgttatcagaagttcgccaatgcctcggtgagagacttaaagggctacaatgcgaagatcgaatccctgccgacgatcgagggcgatccgaagccggaaaagctgccgcagattgtgattatcgtggacgagctggcggatcttatgatggtatcgccgggcgaagtcgaggaatccatctgccgtctggcacagctcgcaagagcgtgcggcattcatttgatcattgcgacacagcgtccgtcggtcaatgtcattaccggtctgatcaaggcgaatatgccgagccgtatcgcctttgccgtgacttcgggcgtggattcgagaaccattctggatatgaacggcgccgagaagctcctcggcaagggagacatgctgttcagcccgcagggaattccaaagccggtgcgtgtgcagggcgcatttgtatcggatgaggaagtatctgccgttgtagggtttatcaaggaacagaatggtcaggtgacctacagtgcggagatggaggagaagctgagcaacatggaatccgccaacaccaccgtagcgatcgattccagcgcggatgcaggggacggcagggacgtttattttgcagatgcggcgcgccttctcatggagaaggaaaaaggttccatcggcatgcttcagcggtattttaaaatcggttttaaccgtgcagcccgcattatggatcaactggaggaagcgggtatcgtaggtcctgaggaaggcacaaagccgcggcgggttttaatgtcgcccgagcagtttgagcagtacgaagaggaatatctgtaacaggattcatataaaacatacaaagccgctctggcggcggaatggaggagacattatgaaaagtgatattgaaattgcacaggaagcccagatggtacatattcgcgaggtggctgcaaagcttgacatcccggaggatgatctggaattgtacggaaagtacaaggcaaagctttcggacgagctgatccgtcgggtttccgacagaaaagacgggaaactgattcttgtgaccgcaatcaatccaacgccggcgggagagggaaagaccaccacgagcgtcggcctcggcgaggcattcggcagacttgggaaaagggcggtcatcgcgttaagagagccgtcccttggaccgtgttttggaatcaagggaggtgcagccggcggcggatacgcgcaggttgtgccgatggaggatctgaatctgcactttaccggtgatttccatgcaattacctccgccaacaatctcctggcggctcttctggacaaccatatccagcagggcaatgagcttggaattgatccgcggcagatcgtctggaaacgctgcatggatatgaacgaccgtgtcctccgtaacattgtcgtcggtctgggaagcaagatggacggaatggtaagagaagatcactttgtcatcacggttgcgtcggagattatggctattctttgtctggctgacgatatgcatgacttaaagcgccggctcggacggattatcgtcgcatatacgtttgacggaaagccggtgaccgcggacgatctgaaagcgaccggcgcgatggcggcactgttaaaggacgcgctaaagccgaacctgatccagacgttagagcacacgcctgccattgttcacggaggtccgttcgccaatattgcgcacggatgcaacagtgtccgtgctacaaagacagccttaaagctcgcggattatgtgattacggaggccggctttggcgcagatctcggcgctgaaaaattcttcgatatcaagtgccggaaagcaggactggcaccggatgccgttgtgctggttgcaactgtgcgtgcactcaaatacaacggcggcgtggcgaaagcggatcttggcacagagaatctggacgcgttgaagaaaggaattgtcaacctggagaagcatattgagaacctgcagaagttcggtgtgccggttgtggttaccttgaactcctttgtcacagacacaaaagcggagacggattacgtggagcagttctgcagagaacgcggatgtgagtttgcactttccgaggtctgggaaaagggcggtgaaggcggcattgagcttgccaacaaggtgctgcttacactggagcagaaggaaagccatttcaagccattatatccggatgatatgagccttgaggataagatcgcaactgttgcgagagagatttacggagccgacggagtgacctattccgcagctgccaaaaaggaactgaagagaattaccgatatgggaatgtcatccttcccggtctgcatggcaaagacacagtattctctttcggatgaccagacgaagcttggaagaccgaacggttttaccatcaatgtgcgcgaggtttacgtatcggcaggagccggctttgtcgttgcagttaccggttcgatcatgacgatgccgggactttccaagaacccggcggcgtacggtattgatgtcaatgatgacggagtcattaccggattattctaagagacagaatggaggatacgtatgacacagatcattgacggaaaaaagatttcacaggagatcaaggacgaactgcgcgagcaggttgcggaacagaaaaagcttggaaaagaagcagcgcttgcagtgatccaggtaggaaccgatccggcttccagcgtgtatgtcaataacaaaaagaaagcctgcgcctatatcggcatcggttccctgtcctatgaactgccggaggagacgacggaggaagaacttcttgcgcttgtggagaagctgaatggtgatgcttcggtaaacggaattctggtgcagcttccgcttccggcacagattgacgcagacaaagtgattcgtgcgatcgcacccgaaaaggatgtggacggattccacccggaaaacgttggaaagcttgtgatcggggagccgggatttgtctcctgcacaccggcgggaatcatccagctcttaaagcgctccggaattaagatggaaggaaaacattgtgtgataatcggcagaagcaatatcgtggggaagccgatggcacttttaatgctacgcgagaatgccacggtcaccattgcacattccaagacacagaatctgccggaactttgcaaaacggcggatatcctgatcgttgcaatcggaaagccgcagtttatcacggcagattacatcaaagaaggggcggttgtcatcgatgtgggaattcaccgcgatgagaacaacaagctgtgcggggatgtcagatatgatgaggttgcgccgcatacgtcggcgatcacaccggttccgggcggagtagggcctatgaccattgcaatgctgatgcataattgtgtggagtccatgttgcagtaacagatgtagaatccatatggatgaaagagtgagaggaatcgtttcatatgaaatgtgcaaagtgtggggcagagatcaaagagggatgtatctactgctccgtgtgtggaaatgcggtacagattgtgccggattacagtgtgttggaggatgactatctgcgttctcttctaaaagaggaggaatctgccgggaaggaaccggcgccggcacaggcaaagcagcaaaagcccaaacagccgcagaggaagaaaaatcgccggctgccatttctcatcgggggaattctgctggtgcttctcgttctggcgggaattctgattaaggctgcaattgatcaccggaatgccaattcttacgactatcagatggaacaggcggccatggcggctgatgcgcagaatgacggggaggcacttgactattacgagcgtgcgctgtatctgtatccaaacgatattaccgcgcgtgagaagatgattgaaatctatgaaaaacagaaaaataccgatgcggcaatggtgctcctgattgagatcataaagcttgatcctgccaatgaggacgcatacagagatctgatcgctatctatgatgcgagggaagattacgacagcattctggatctggaagcggaggtcgatgccgaggatcttaagaataaggataagattctggatttgtttgcggattacatgacatctgcaccgctgattacggatcctgagggagatgtgccgtccggaaagtatgatgaggcgctcgaggtagagattgcgtcgacagacggggatgccatctactatacgatcaatggagatgagaacgaactggatgccaagaccggaacgaggtattttgtcggaaacccgctcgtctttgatgagagtggcaaatataccatcgcggcggtctgccggaacgataagggaatctacagttccgtgacgtatgccgattttgagatcgaacttgcaccaccggattttgcagaggtgtcgccggacggaggccgtttttatgagccgacactcgtgacgctgaccgcagaggatggatgcagcatttactatacctgggacggaaccgatcctaccacggcgtctgcgcgctacacggagccgtttgaggtgccggagggcaacaatgtcctgtccgtacttgtggtggacaaaaagacgggattggacagcggtgtttaccgtgccaattttatctattacccgtaaaaaggaattgccgcaataagcataacctctttggggtgataagtaatattataagaaacatacttggagatttcatgtggaaatgcagatggaaattcgtttgagaaaaatgtgagtatttcttccagccgaatgtttgcatcggattccgtgtctcttccacgtttgaacactcccggagtgtgtccgccaaatcagagacaatgagcaaactttctagtggcggctaatgctgctgcttcacagacactataaaatcgcgcgaaccgaaactcgctgccatctgctattgaaaataaggcagatggcagcgagtttcggttcgcgcgattatgttttattcagcagcggcaaaagcgccacacgaaagttcttaaattgtctcatgatttgcggacacagtccgtggagtgctccaaacttggaaagacatggatcatcgcagattgcaaacatccggctggttagaaatgccacattttttgaaccgaattttcatctgcatttccatctgaaatcccacggtgtggtcttttaataatattacttatcagcgcaaagtacaatacgcttattgcgacaatccccttttagaagatcactcgtcgtccgccggtaaaaattcaacgtggtccgtatccattgcaccgactctggcaagtgcatacacttcggttccctgatcaaccagcttttcacgtcctggctggaaagacttttccaccagaacgccgagaccggcgatggtcgcatgtgccagacgcagaagacggatcgctccggtcgcagcctcaccgtttgcaaggaaatcatcgatgattaagacgtgatcctcctcggagatgtacttcttggagagcgtcagctcgtagttcgtctctttggtaaaggatgtgatcacagtctggtagagattatcatttaaaatctgagaaggctgcttcttcaaaattaccataggaacgcccagcgcagatgcggtcatgagtgcaggagcaattccagaactttcgatagtaaccactttcgtgatgcctctgcctttaaaatgtgcggcaaatgcctccccgatctgtgccatgagcaccggatccacctgatgattgataaaactgtctaccttaagaatgtctttgtttaatgcctttccctcggaaagaatcttttcttccagtaatttcaaaatcgtcacctctcaatagtatatttgatggttctattgtaccataagtcgctgcatgaaagaagtgctgttttggagaaatgtcccgattttagaaaagctcggcgtagagcagttcaatcatatgatcggtaaaggattccgaaagggagggatactgatgaagcagcagcttttccatcacttcgtagcgggaaaaatacagcgcctcctccggctgatcgttgtcgacggactgatcaatgacatcggcacggtaggtatccagaaaccatttgaggatctcatcctgcagtgcatcttctgttgcagtcgcatctttgagctgtttgatctgtccgaaggaacggatgccgatccacaaaaagataacgaacatgattcccatgacaagacccatcagaattctggcggcaccggtaatatggatcggaagaacgccgcagaaaaacagcactaaaagaaccagtccgatgatgccgaccccggtaaaggtgtaggcggtagacttcatatcttcggtctgggaagccttggaccggtaggcgtgtgaatgtgcagtaagcggcggagtatctcctctgccgccttccgctgccctgacggtggaagctgccgaaagttcttccatgtcatcaggggagaaggcatccggactgtcttttgatttgtcctctgatatggagagcgactccaccagatccacgccgcagtccggacagcggacgattcccgctacatattcgtttttacattctggacaccacataataagttctcgctttcttagttttcttttcctatattataggagattttatagactgccgcaaccaaagaatgttataatgaacctgctatgaagattacaattttatgcgttggaaaaatcaaagaaaaattttacagagatgccatcgaggaatacgctaagcgcctgacgcgctattgcaagctggaaatcatcgaggtcgcagatgaaaagacgccagacggcgcaagtgccacggaagaaatgcagatccggcaaaaggagggggagcgtgtgcttgcccgcctcgagaaatgcaggcagagcagctcctatgtcatggcactcgccatagacggcagagaactcgattcggtcgaactctcacagaaactggaaaaactgggaactgacgggatcagcaatgtgatctttttgatcggtgggtcactcggcatgtcaaaagagctgcttgcggcggcggattttaagctctctttttccagaatgacgtttccacaccagctgatgcgcgtgattctgctggagcagatctaccgcggctaccgcatcatgaaccgggaaccctaccacaaatagcggcaggctattcggtaaagtccctggaatacagaacggttccgtccggatttaaggcggtcagccggatggcgatgccgtttatgccggtctcatctgcaatctgcgcgcgcagcgaggaaaaagtggaggcatagctgtcaaaaatggcgtcatacagctgcgtcagtgcgtcggcgtctgcatcatccgacatatcatacgccttagaaagcgtgtactggaacactaacgcatcggaatctgcggtgacaatgtccagggtgtatcccagatcctgggaattgacggcgtctgtcatctcctgaaactgatccgcctgtgtggcataccagtcatccagcgatgcttttttacatcccatcagagccattcccaagcaaaaaagtgcgagcacgcacagtaatattctgtggctttgaatttgatatccggtcataacggtctccttttccctgtagaagcttaaaaatctatcatcagtatagaagtccgccgcacgacttgtcaagcgtccgcgcggcaaatgttgaatcggcggttaaacggtgttacaataaagtatactttagaaataagggggattgcagtatgagaatgtatgatttgatcttaaaaaagaagcagggcggggaactttccacggatgagatccgctatatgatagaaggttttacggagggaagcattccggattatcagatgtccgccatgacaatggcgatctgttttcgcggaatgacgccgcgcgagacggtggatttaacgcttgccatgagggacagcggtgatgtgctggatctctcggggatcaagggggtaaaggtcgataagcacagcaccggaggcgtgggagacaagacctcactggcgctgacaccgatcattgctgcgctcggggttccggttgcgaaaatgtccggcaggggactggggcataccggcggaacaatcgacaagttagaatgttttgacgggtttacgaccgcgctctccgaggagcagtttgccgggaatgtcaataccatcgggattgccattgcgggacagactgccaatctggcgccggcggacaagaaattatacgcgctgcgtgatgtgacggcaacggtggatcagatgtcgctcattgccagctccatcatgagcaaaaagctggcgtccggaagcgatgccatcgttctggatgtcaagacgggcaacggcgcttttatgaaaaagcttgaggattccagagcgctcgcaaaagagatggtctccatcggtacgatggcgggcaagaagacggtggctgtcatcacggatatggatcagccgttgggacgcgcggtcggcaattcacttgaggtccgggaagcgattgataccctgcgcggagagggaccggctgatttcaaagaagtggtgtttgcactgggcagccagatgcttatgctcgcagggcgggcggcggacgaaaaggaagcccgcgcactgatggagggcgtgatagaagacggatcggcactcgataaatttgcccagttcgtgcgcgcacagggcggagatgctgcaccggtctatgacacatcccttctgccggttgcggggaagacactagaggtcacggcaaaagagagcggatatgtgcaccggattctggcggaagacatcggaattgcctgcatgaccctgggaggcggaagagagaccaaggagagtgcgattgatctatccgttggtattattctggagaaaaagaacggggatgcggtaagtgacggtgaagtgcttgcgacgatttatggcaatgatgatgccaaaatgcaggcggcgtatgaaaaaattgcccatgcctacgagatcgccaaagagccggcggctttcgtgccggtggtcagagaatatatctttccagaataagacggtatttttcctcatatagtgctatatgagaaaaaatagcagaacttcagcggggtcacagatttcgctgcgcgaaagaattgtagataacctggagcttcccaaagacctcatgctcggggcggcgatcgtgaccgtcaccggcagaggggaagctgtgatttcaaattataaaggaatcctggaatacgaggattcctttatccgggtgcagacaaaaacctgcaggatacggattaccggtgtccgtcttgccatagattattacacgaatgaagaaatgaaaataacgggcagcattgatacgatagagtacgagaactgagacgatgttgctctctgtgatcaaatattttcgcggttatgttcatgtgaagctgacgggatatgcaccggaacggttcttaaatctgtgcgggaaccggaatatcctgatctggaatttaaaaccgtgtgaaaatggatatactttttgtatcagtgtcgatgcattccgacagctgaagcccattctgaaaaaaaccaaaacgcagatccggattcagaagcgtgtggggatgccgttttgcgcgtttcgctaccgcagacggtatcttttcccggcaggcctgctttttttctgctttttgctgtatgatctgtccggattcatctggaatatcgaaatcaacgggaattcttatctgaccacggagacgattctggatttcctggaggaggaacacgcatcgtttggaacgaaaaaatcccagatttcgtgcgaggatctggaagaagccatgcggagccgctaccgggatgtcatctggacttccatcaagatttatggtacaaagatgacggtcgatattcaggaaaacctcctgtcgcaggaagaatatgaggcgaagagcgatgaaccgcaggacattgtcgccgccaaagacggcgtgattaccgagatggtgacacgcgcgggcacgccgcttaccgcggtgggagcggaggtaaagaaaggcgacatcttagtctcggggcgcattgaagtgttaaacgacgacggtgagatcatgcagtacctctaccgtccgtccgatgcggacatcaaggcgaaggtactctattcctaccgggatgtgattgatggcacctgggtggagatggcaccgaccgggaacacgaaggagcgttacagcatcacgctgcttgataacgtgttcgactggccgcttttccggaatccgtttgcagagtatcaggtgcagacggagagcaggcagctccatgtggcggacaatttttatctgcccgtgtggctgaataaaagtgagttcacagaggtcgagcaggtgcggcacgagcgcaccgaagcggagatccgtcagattgccacaaagaatttctcggattacatcaaagatttggaagaaaaaggtattcaaattatatcaaaaaatgttattataaaaagtacgggtgaaaaatatgtggtaagcggcgatctgtgggcgcacgaatccattgtttcctatcagccgacagaggtttacgataccacaatgcaagaaaggcagaatgaaaatgagtctgactgaagtttcgttaaatataccgacagaccacatggcgaatgtgttcggtcagtttgatgtctatatcaaaaaaatcgagcgtaccttgaatgtgacggtggttgtccggggagaagatatgaaaatcctcggagacgaaagacgctgcaggcgcgcgcaggatgttttcatgcagcttctggaattgtccaaacgcggaaatgtcatcacggaacagaatgtcaactatgcactggcattgatggcggaggaaaaagagtcggcgatcgtggagatcgaccgcgactgcatctgccacacgatcaacggcaagccggtaaagcccaagacactcggtcagaaagcctatgtggatgccatccgcgaaaagatgatcgtgttcggcatgggaccggcgggtaccggtaagacctatctggcgatggcgatggcaatcaccgcgtttaaaaacgaggaggtcgggcggattatccttaccaggcctgcgattgaggcgggggagaagcttggcttccttccgggcgatctgcagagcaaggttgatccttacttaagaccgctttacgacgcgctgtatcagattatgggggcggaaagcttccagaagaatatggaaaagggattgattgaggtggctccgcttgcctacatgcgcggacgtacgttagataacgcatttatcattctggacgaggcgcagaacacgacgccggcgcagatgaagatgtttctgaccagaatcggtttcggttcaaaggcggtcatcaccggtgacgccacccagaaggatctggcgccggatgccgcatcgggcttggacattgcgctgaaagtgctgcgcaatgtggaggagatcggtatctgcgaactgacaagccaggatgtcgtgcggcatccggtggtgcagaagattgtcaaggcatacgaggattatgagaagcgcgccggtaagacgtccggcacgagaaagaacacgagcagaaccggagcgggcagaaccggtgcgagaagcaggagagagaacacgaatggatgatcgctatgtggcaaagagagtaatatatctgcttggcatgtctgccgcaacgatcctgtttacgacagcggcggcatttatcaggggacagtatctcgacgagtggatcgtccttgttatcatcaatctggtatttctggcgttgtggttctttttattggagcactgccggatgaagcggagcattgcgggaaaccgtgagacaagctaccggcgtatttttgcagggtatctggcgtcgcttggcgtgacggcggtctgtcttgtacttccggaattttcaagacctgtgatgctatctgccattttgatgctcggtgtggggaatatcgagctttccctgtgcagcggactctttttctgcagcctgctcggtcttttgtgcggtggaaccatccaggaattctccatgtatatcctgctggttctgatcggagcggtggcagcggacgcagtggaaaacagcaaaaagcagttctggtatgaatggtttgctggcatggcaggcatgcttcttccggttctgttctactatctgacctaccgggagatcagtgtccggatcatggtatctgccgtggcggacggtgtggtcgtctttttgtttttgcatctgtgctaccggaagttagcggatgcaagaaatgcggaagtcgatgaggtcatggtcgacatcaccgatgaatcctatccgctggcgcgggaactggcgagtttttccagggcagactacagccatgcaaggcgggtaatgcttgtggcggcgcgatgtgctgctgtggtcggggcagacgaacgtgtgtgcagcgccgcggggatgtattaccgtatcggcgtactggagggcgcaccgcttgcaaaaaacggtgtgaaaatggcacagagagcctgcttcccggagaaggtaatccgcattatcggggaatacaacggggaagaggccctgccatccaccatcgagtcggcgattgtacatatggtggacgggctgttgaaaaaactggaggttctggatgaggataccgttggcagcaactggaaccaggatatggtgatctatcagaccttgaatgaatattctgccgcggggctgtatgaccgttccgggcttagcatgaatatgtttttgaaaatacgggaatatcttgtgaacgaggaggcattactggtatgagcctgaatttagaagtcgaagtggacgtgccatttacatttgattatgaagcgctggcgggcgaggttgtcgcttttaccatcgaccatgaaggttttccttatgaggcggaagtgaatctgacgctgacggacaatgaaggaattcatgagatcaaccggatgtaccgacagattgatgcaccgacggacgttttgtctttcccgatgctctcctatgagcaggcgggcgatttctcggcgttggaagaggattatgaggataattttaatccggataccggggagatcatgctgggagacattgtcatctcggtggaccgggtgagagagcaggctgccgcctacggacacagcgagcgcagggaatttgcgtttctgatcgtgcacagcatgcttcatctgttcgggtatgaccacatgacgccggaggacgcggcagtcatggagccgaagcagagacagattctggaggagatgaacatctcgcgtgattaacgaacggcggcgccgtggcgcttccgaaaggatttgaggtacttttatgggcaataaaaaaaggaaaaatacgacaagttttctggcgcagggcacaatcctcgcggcggcttcgctgatcagccgtgtgatcggcctgatttaccgcatgccgctgacggcgattattggggataccggcaacgactattatggcagtgcctataccatctataatattttgttaattatttcgtcctacagcctgccgctcgcggtatccaaacttgtctcggcaaatatctcacagggcagaaggcgcaatgtctaccgcatcttaaagtgcgcgctgatttttgcgctggtgtccggaaccgctgccgcggcaattctctatttcggagcggattttattacgggtacgctgcttagaaccccactttgtatctttgcgttaaaggttttagtgccggttcttgtaattgttgcggtcttaggtgtgatgcgaggctttttccagggacttggcacgatgatgccgagtgccgtatcccagatcttagagcagattgtaaatgcgattgtcagcgtgtgggcggcgtatgtccttttttcctacggttccaaagccggagcgcttttaggcaatgccgaggattacggcgcagcctacggtgcggcgggcggaacgatcggaaccgctgccggagcgctgagtgcgctgctgtttgcgggttttgtccttgttgtctatctgcgggtgtttaaaaagacgcttcgcaaggagcggaagacaagcgcagattcgtacggagagatttttaaactgctgatcatcaccattattccggtgctggtgagcagcacgatctacaactgcaacgccaccattgaccaggcggtctacaagaatatcgcggcatggcagggatattccaagacggactacggtacctggaacggtatctataccggaaaataccaggtgttaatcaatgtgccgctggccattgcatcctcccttgcggcatcgagtgtgccggcgctctctgctgcttatgcgagcggaaaacgaggcgaggcgaaacggcagattgggcttgccacacgctttatcatggtcgtggcattcccgtgtgcagtcggaatgggcgtgcttgcctccccgattcttcagatgctgtttggtgattcctccgagcttgcggcaagaatgctgcagaccggttccgtggccatcattttcttctccctgtcgaccctttccaacggtctgctgcaggggatgaatcggatgaaggagccgatcaagaatgcagtgattgcactggcgcttcacttgatcattctggtggcgctgatgcttgggctggatctgaacatttttgcggtgatcatcgcaaatgcatgcttcggactgatcatgtgtattctaaatgcgcgctcgatccgccgttacagcggataccgtcaggaagtgcggcgcacgtttttcgtgccggcggtttcagcggctggaatgggcgtggtggtatggcttgtttaccgtctgttcctctatctgcttcggagcaatctgatcgcaacgcttgtatcgattgttgcaggcgtctttacctacgcgacgctgcttttgatgcttaagggactgaccgagcaggaaatcctgcgcttcccgaaaggcagaacgcttgtaaaactcgcgcggaagatgcatcttttgcgttaattgaataaaaaggaaagaactggcagatacttatcgcagagaatgggaggacattatgaaacggacgataggtatttgcctttttgcggcagtgatgctgtttgccggaggcttgtgcgggaaaaacgcatttgatgcagaaaggatccgtacggcagaggagacggaggcggtcacggaagatgccgcagtgacacagacggagcggactgcggagagcatgcagatccagaaaacctgccgctatctgctccgcatggatgacgacggcatcttaaaagtctatgaggcggacgggataacccttttatttgagaccaacatccgtgcggaacggctttccgtgcagacgagggagcagctttccgacggaattccggtagacgatgagagagaactgtacgatctgctcgaaagctattccagctgacgtaagagaagttattcattgaatgttacagggctgtgtggtaaaattgttacggttaagaagaacggacagaatgatacagcggttagataagaggttgaaatgacagatatagatgttacggtgatcggtggcggcgcggcaggacttatggcggcggtcagtgcagccaggtgcggcgcgagaacacgggtgatcgaacacatggaccggattggaaaaaagattctatccaccggcaacggaaaatgtaattacacaaatgcagtgcaggggctttcctgttatcgtggagagaaccctgcttttgtgctgcctgtttttgagcagttcgggcaggaggataccgtgcgcctgtttgaagaacttggaatctatccgaagatcaaaaacggttactattatccggcgagtgagcaggcggtgtctgtcgtggaagtgtttggcatggaatgcgattacctcggcgttgatctgtggacgtcctgcggactgcaatccattcaaaaaacctgtaccgggtatgaaatacgcaccacaaaaggcgcgttttcaaccaaaacagtgatttttgcgcccggattgctggcagcacccaagacaggaagcgacggaagtgcatttccatatatagaagcacttggtcatcattttgtagatgtggtgccagctctcgtgcaactgcatggaaaacaggcatttttcaagaaacttgcaggaattcgtgcagaaatgcaggtaacactctacctggaaaatgcgcaatttcaaccaaaaggcagccgtgggacagcccggggagaaaagcctgacacggtgtgcagtgagcggggcgaacttcagcttacggcttccggaatctcgggtatcccggtctttcagatcagccgttatgcgacaagagcgctcgcggacgaaaagcatccctacgtgctgattgattttgcgccggatcttacggacaaggagttttttgacctgctgtcagagcgcttctacgagaatacacatggcaagagcgccggggaggcactgatcggtctctttaacagaaagctgagcgaggtactgctctccgaagctggcatacggtcggaactctatgccggggaggtggcacgcgccacgttgcaccggctggtgaagtgtgtcaagaatttccgggttgatattaccggaagcaacggaatggaagcggcgcaggtatgcgcagggggcgttgacacggaggagattgaagctacaacgcttgcgtcaaagctggcagacggtatctattttgcgggcgaggtcattgatattgacggcacctgcggcggttacaatctgcagtgggcgtggtcgagcggctttgtggcggggatgcatgcagcagaggaaggaatgtcagaacagagatgatacggatcaatcagataaaaatgccgctgcatcacaatgcggcagcactggaacagaaaatcagaaaacgtctgggactttcgggagaccaggagcttcgctaccggattatcagaaaatccattgacgcgagaaagaaaccggaactgtcgttggtgtattccgtggaggtttccacttccggagaagagaaaatcataaaaagggcaaacgatccgaatgttacgatcgtaaagcagaccggttatcatctgcccggggcggtttcgccaacgccgtccatcccgccggtgattgtcggtgcgggtcctgcgggacttttctgcgcgtatgcgctcacgatgagcggctgtgcaccggttgtccttgagcgcgggcgttcagtgacggagcgcacaaaggatgtggagcgcttctgggagagcggagtgttggatacggtttccaacgtgcagttcggagagggcggcgcaggaactttttcggacggcaaattaaatacactggtcaaggatcccaccggcaggaaccggtttgttctggaaacctttgtgaaattcggagcgccggagcagattctgtacgaaaacaaaccgcacatcggaacggatattcttgccggagtcatcaaaaacatgcggcaggcgatggaagcgcgcggcgccaggttttgctttgagagttgtatgacagattaccgcagggaagcggacggaaagatgtttgttgaggtcaaccacaaggagtggatcgagacttccagactcgttcttgcaatcggtcacagtgcgcgggacacgtttgggatgctgtatcagaagcaggatcttgtcatggaggcaaaagcgtttgcggttggtttccgtgtggaacacccgcaggagatgatgaatctgcagcaatatggagcgctgcatgcacacgaacttccggcagccccctacaaagtgacagcgaacctcgcaaacggcagaggcgtgtattccttctgcatgtgtccgggcggatatgtggtaaacgcatcctccgaggaaggcaggcttgcggtcaatggaatgagctattccggacgtgacgggaaaaacgcaaacagtgcgattattgtggcggtaactcctgacgactttgcggggaaagatccgctagccggtgtccgttttcaggagatgctcgaggagcgggcattcgctatcggaaaagggcggattccgcagcagctttttggagactattgcagcaatcgtgcctcggtgtcttacggggcgtttgagagcgccacaaagggcgcatgtgtgcttggcaatttaagaggtctgctgccgcaggcactggaagagtcctttatcgaggggatgcacgcattcagccgccggattccggcttttgaccgggaagacgccatcctctccggcgtggagagccggacgtcctcaccggtgcgcctggtgcgcgatccgaagcttcttgtggctgcaggcggcatctatccgtgtggggagggcgcgggctatgcaggcggcatcatgtccgcggcgatggacggactgaaagtggcagaggcgattatgagagatatggaggagcaacgtggctgaatttacaccaatgatgcagcaatatctgcagacgaaggaagaatataaagactgtatcctgttttaccggctgggagatttctacgagatgttttttgaggatgccgaactggtgtccaaagaactggaactgacgctgaccggaaaaaactgcggcatggaggagcgcgcaccgatgtgcggcatcccgtaccatgcggtggagggatacttaaataaacttgtggcaaacggacacaaggttgccatctgcgagcaggtggaagatccgaagctggcaaagggactggtcaagcgcgaggtcatccggatcgtgacgccgggaacgaacctggatatgcaggcgctggacgaatccaagaacaattatattatgtgcatcgtgtatctggcagaccgctacggcgtatccattgcggacgtctcaaccggagactactatgtcaccgaggtggattcggagcggaagcttttcgatgagatcacaaaattttcgccatctgaaattatatgcaacgaaagtttttatatgagtggtgtcgatatagaagatttaaggcatcgactcaagattacaatttatgcgctggagacatggtattttggggatgagcttgcagagacaacactgcttacacactttaaggtaaagagtctggaggcgctgggacttgccgattatgactgcggcatgattgctgcgggagcactgttaaagtatctgtacgagacacagaagaacgatctcaacaacatttccgtgattcatccgtattccaccggaaaatacatgatcatcgacagctcgaccagaaggaatctggagcttgtggaaacgctgcgcgagaagcagaaacgcggatcgctcctgtgggtgcttgacaagacgaagacggcgatgggtgccagactgctccgctcctatgtggaacagccgctgattgacaaggcggagatcgagaagcgccaggatgcaatctgtgagctgaatcagcacgtgattaccagagaggaactccgggaatatttaaatccgatctacgatctggagcgtctgattacgcgtgttacatatctgaccgccaatcccagggatctcattgccttccgcagttcgattgccatgctgccgccgatcaagagtcttttgggcgattttcagtgcgagctgctgggagaaatccgcgaggacatggatacgttggaggagctctgcgcactgatcgaccgggctatcatggaggaaccgcccatttcggtgcgggacggcggtctgatcaaggacggctacaacgaggatgtcgataaataccgcaaggcgaagacggaggggaagacctggctggcggaactggaagccaaagagcgtgaaaagacaggcatcaagaatttaaaaatcaaatataacaaggtattcggctattatctggaagtgaccaactcctacaaggatctggttccagattattttatgcgcaagcagacgctcgccaacgccgagcgctatatcacgccggaattaaaagaactggaggacatgattctcggcgcggaggacaagcttgtcacattagagtacgatctcttctgtgaggtgcggagtacgatcgctgcggaggttgtgcgcatccagcggaccgccaaggcggttgccggtctggatgtattcgtgtcgctcgcacttgtcgcggatcagaataattactgccgtccgaaaatcaacgagaacggcatcattgacatcaagggcggacgtcatccggtggtcgagaagatgatcaacaacgatatgtttattgacaatgacacgtacctcgacaacggcaatcaccgcatctcgatcattacgggaccgaacatggcgggaaaatccacctatatgcgccagacggcgctgatcgttctgatggcgcagcttggcagctatgtgcctgcggcatccgcgaagatcggtatcgtggaccgcattttcacacgtgtgggagcgtcggatgatcttgccagcgggcagagtacgtttatggtggagatgaatgaggttgcaaatattctgcgcaacgctacctccaactcgctgctgatcttggatgaaatcgggcgcggcacaagcacctacgacgggctgagcattgcctgggcggtggtggagcatatcagcaacccgaagctcctcggtgccaagacgctttttgccacacattatcatgaactgacagagctggaaggcaaattaaacaacgtcaacaattactgcgtggcggtaaaggaaaagggcgatgacattgtatttctccgcaaaatcgtaaagggcggcgcggacaagagttacggtatccaggtggcaaagcttgccggcgtgccggattctgtcattgcgcgtgccaaggagatcgtggaggaattaagtgccaacgacatcacggaagttgcgagaaatatctccgtcgatacgggaagcaaaaagaaaaaagaaaagctggacgaggtggatctgacgcagatgtcgttgtttgataccgtgcgggacgatgacatcatagaggaactgcggaatgtggatgtcggaaatctgacgccgattgaggctttaaacaaattatacgaacttcagaacaaggtaaagaaccgctggtaaccggaagcgcctttggcaaaggcagatgggaggaatggaatgccgcagataacactgctttcgcaggaaacaatcgataaaatagcagccggggaggtggtggaacggccgtcctcggtggtcaaggagcttgtcgagaacgcgatcgatgcccgggcaaccgccgtcacggtcgagatcaaggagggcggcacaacgttcgtgcgcattacggataacggctgcggaattgagcgtgagcaggtaccgctcgcgtttctgcgccattccaccagcaagattaagagtgtggaagaccttttatgcatccattcgctcgggtttcgcggtgaggcgctctcaagcattgccgccgtatcgcaggtggagctgattaccaagacttacagcgatctgaccggaacgcgctatgtcattgaaggctcaagagagatgagcaacgatgagatcggcgcgccggacggcacgaccttcatcgtcagaaacctcttttacaatacgccggcacggaaaaagtttttaaaaaccgcgcagacggagggaaattatatcagtgacctgatagagcgccttgccttgtcccatccggatgtctcttttaagtttatcagcaacggacagaccaagatgcatacctccggcaactccaatgaaaaagatctgatctatcatatctacgggcgcgatattacggcggcgcttcttccggtctgcgcagagacagaatatttctcggtaaagggctttgtcggaaaaccgatgatttcccgcggaaaccgcagctacgaaagctattttatcaatggacgctacatcaaaagcgcactgctctccaaagcggtggaagaggcgtacaagggctttatgatgcagcatcagtatccgttctgcgtgctgtattttaccatggatacggagcttttggacgtcaatgtgcatccgaccaagatggagcttcgtttttccaacaatgaggaagtgtaccggaagctatatcagacgatccgcgatgtgctgactcacaaggaatttattccggctgtcccggtggaggaaaagaaagaagaaaagcggccagccattaccggtagcctgccggagccatttgagacaaaacgtctgcatatcccgccgcagacacaggtgctgccgcaggggcagaacgtgacgccggaaccagtcagaacaccggaaaatctggacgtgttccggcagcttctggtgcgggaggagagcagctatcatgcggattccgcatctgcgggttctgcttcggccgaagacggcagccggatacaggagatgtcatgggaagcggaatgcataccggcggcggataccgtacagccggatgtgcagccggagccgattcctaaggcagaggccgtgcggggaactcctgatacaccggagaatctgaatacgccggagaatctgaatatgccggagaatctgaatatgccggagacagacacacagaatgtgcaggagacgcagaatccgcaggagacagcggacacggtcgtgtacgagcagcagacgctcgaggcggcggacaccggatttttcacgccggatgcagccagacggcaccggatcatcggcgaagtgtttgacacctactggctgattgaatacgaggataagctgttcattatcgaccagcatgccgcccatgaaaaagtgctctatgagcgcaccatggcgcgcgtccgcacacagaattttgcctcgcagacgctaagcccgccgatcattctgacgttgagcgccgaggaacaggaaatgcttacacgctacggggagcagatccgtctgttcggttatgaggtggagccgttcggcggcaaggaatttgccatcacggcgattccagccgattttgaggcggtcgatatgaaaggcatgttcttggacatgctggacgattttaccaacataagcggcagggaagcaccggaactgatcttggagaaggtggcttccatgtcctgcaaggcggcgatcaagggaggcgattccatcagcagggcggaggcagaacagctgatcgacgagttgctgtccctggagaatccctaccattgtccgcacgggcggccgaccattatctccatgagcaaatatgagattgaaaagaagtttaagaggattgtatgacaatgaaaccaaatcccatggtaattctgaccggcccgacagcggtcgggaagacagcgctttccattgcactggcgaaaaaaataaacggagccattatatctgcggattccatgcaggtgtataaatacatggatatcggctcggcaaaaatcatgccggaggagatggacggcgtccggcactatcttgtggacgaactggatccatccgatgagttccatgtcgtccgttttgtggagatggcaaagcaggcgttaaaagagattacggcaaacggtcagatccccattgtggtgggcggaaccggattctatatccaggcgctgctctacgatattgattttacggagcaggagtgtgacagtgcataccgcaggcagctggaagagctggcagagacacgcgggaatcattatcttcacgaaatgctaaaggcggtagatccggcatctgcagaggcgatccacgagaataaccgcaagcgcgtcatccgcgccctggaattttaccatgagtccggcgagcggatctccgagcataacgagcgggagagccagaagacatccccctacaactttgcctattttgtcttaaatgacgaccgcgaaaagctttaccgccgcatcgatgcgcgcgttgatgccatggtaaaggctgggcttgtcgatgaggtggcaaggctgcagcagatgggctgccatgcggatatggtgtccatgcagggacttggctataaagagatactggcgtatttaaacggcaccagcaccctggaggaagcgatctatatcatcaagcgcgaatcgagacattttgccaagcggcagctgacctggttccgcagggagcgggatgtcatctggctgaacaagccggattttgagtatgacgatacaaaaatacttacatacatgatggatgtgttacaggcgaaaggaattttgccggcataaaagagaggtacagagatatgaatcagttattacaggaacaatacgagcgtctggggatttccccggaggtaagtgcattcggggaaaaaatagaagcttccttgaagcagcgttttgaagagattgatgcacgcgcagaatacaaccagctaaaagtgttaaaagccatgcaggacaaccgtgtctcggcagaatgtttcaatacgacttccgggtacggctacaacgatctgggcagagacaccctggaaaaagtctatgcctcctgcttcggcggggaggatgcgctggtgcgtccgcagatcacgtgcggcacccacgcgctggcgctggctctgatgtccaatctgcggccgggcgatgaactgttatccccggtcggcaagccatacgatacgctggaggaggtcatcggcatccggccgtccaagggatcgctcgccgagtacggcattacctaccgtcaggtggatctgcttgcggacggagagtttgactatgaaggcatccgcgccgccatcaacgagcgcacgcatcttgtcaccatccagcgttccaagggatatgcgccgcgcaagacgctctctgtggagcgcatcggaaaactgatcgcattcatcaaggacatcaaaccggacgtgatctgcatggtcgacaactgctacggcgaattcgtggaagagcgtgagccgattgaggtcggggcagacatgattgtcggttccctcatcaagaatccgggcggcggacttgcaccgatcggcggctatattgtcggcaaaaaagaatgtgtggaaaatgcggcataccgtctgacttccccgggactcggcaaggaggtcggcgcttccctcggcattctgcagtcgttctaccagggactgttcctggcaccgaccgtggtgagcggcgcgttaaagggcgctatttttgcggcaaatatttatgaaaagctgggatttgacgttgtgccggacggcagtgagagccgtcacgacatcatccaggcgatttccttccacaatccggacgcactgatcgccttctgcgagggaattcaggctgcggcgcctgtggacagctacgtgacgccggaaccgtgggcgatgccgggctacgacagcgatgtcatcatggcggcaggtgcatttgtgcagggttcctccatcgaactgtctgccgacggaccaatcaaaccgccgtatgccgtgtattttcagggcggtctgacctggtaccatgcgaaactcggcattttgaaatctttacaaaaacttaaggaacgaaaacttgtgaatctggatgcgttatgctaaaatataatgtaagtttttgtcccgtaattggttgacataaattctacaaaccatcatagggaattgccggggagagacgggaaatctttatgaatcatcattttacaacggttaaggaactgccggactcggagaagccatatgagaagtttttaatatccggggtcgaatccttaagcgatgcggagctgattgccgtcatcatacgttcagggacgcgcgggacgcgttctgtggaagtggcgcaggaattgctgcggcaggacggacacgatctgttgaatctctacacgttatctgttcaggatatgcagaagattcccggaatcggacaggtgaaggcgatccagttaaaatgcattgcagaattatccaaacggatggcgaagacgcgctataaagagcgcatctgtcttggcgatccgggctccattgcaagttattacatggaggatatgcggcatgagagcagagagcgtacgatggtgcttctctttgacgccaaatgccgcctgctggagaaggttatgatgtctgtcggtagtgcgacggctgcacttgtctcaccgcgcgagatttttctcgctgcattggacaaaagtgcgattcagattgtgctgatgcacaatcatcccagcggtgatccctccccttcggcggaggacgatgcagtgacaaagagagtggcggagtgcggagcgcttcttggcatccctcttgtggatcacattattatcggtgaccgcacgtactacagctacagagaatgcaaaagaatacaataaagggagagaacaatgacgaataacgtgtatggtattgaccttggtacctgcaatatgaagatttattgtaaggcgtccaacaagattatgaacgagaagaacaccatcgctctggtgaataagaatgagatgtatgcctacggtgatgacgcttatgcaatgtatgagaaggcaccggaaacgattcaggtgacattcccggttgtgggaggcgtgattgcggattttaataatcttcaggtaatgcttcagacttatctggagacccacgccaagggcaagctgcgcggagcggaattcattgttgctgttccaacagatattacggacgtggagaagcgtgcatttttcgacatgttctacaagagcaaattaaagccaaagagcgtgctgttatgtgagaagccgatcgcagatgccgtcggtctcggtctaaacgtcaacgagccgaccggtattatggtggtagacatcggtgcggataccacagagatttccgtcatctcgctgggcgggctggtcttaagtgatctgttacattccggcggcaacaagatcgacgaatccattatcacttatgtgaagcgcaagtacaatcttgtcatcggacagaagaccgcgcagagcatgaaggagaccctcggaagcggtatcccgggcaacacccagaccatggtggttgtcggacgcgacgtggtgagtggtctgccgattgagatggagatgtcgggagctgttgtctatgaggcgatcaaggacaacctcaacacgatctgcaattccatcaaaatgatcctggagaagacgccgcctgaacttgcaagagacattattcattccggcatctatatcacgggaggaagctccaagattcatgatctggatcagctgttccgtgatattacaggaatcgagatcaatacctgcgaggagccggaggagtgtgtggtgcgcggactcttaaagatcgtatccgatgccaagtttaagcatctggcattcagtatgaagaataagatattgttatagaggaaattatgaaacggaaacccaaaattgttttgcctgccaagtacatattgctgattctgaccgttgtctgcgtggcagccatgattaccagctttacgctcaatatctccggcggtccgctcaacgcggttgccggttatgtgtttgttcccatgcagcgcgggatcaacacggtcggcgcatggattacggagaaagccgacaatcttaaaaatttaagcgatgtcatggcggaaaacgatgcgctcaaaaagcaggtggatgagcttacctccgaactgaataccaacaatctggagcagtatgagcttgagaatctgcgcgagcttctggcactggaccagaaatacccgagctatgagaaggtggctgccaatgtcatcggcaagagcagcgggaactggttttcctatttcacgatcgacaagggaaccgacgacggaattgaagtcgacatgaatgtgatcgccggcagcggacttgtcggcattgtcacggacgtcggcccgaattatgccaaagtcacttccattatcaacgatacggcgcagatcagcggtatggtgacgacaacctccgacaacctgatcgtaaacggaagtctccagaacatgaatgagaacatggtcatcgagttttccaatttgaatgacagcgacaataaggtggcggttggcgaccctgttgtcacgtcctacatttcagataaatatcagcagggaatcttaatcggctacatcagcagtctttcgacggattccaacaaccttaccaaatccggcacgatcacgccggcagtggattttgagcatatcgaagaggttcttgtcattctggacaagaagcagtcagccggggagtaggattcatattatgagaagaaaagtaaatgtgtttattatcattgcaatctgtttcctgcttcagaccacgctgtttcaggcattgtctttcgcatcgatctcgccgaaccttctgattatcgtcgtgtcgtccttcgggtttatgcgtgggaaaaaagaaggaatgtatatcggttttgcctgtgggcttctgcttgatatcttcggcagcggaattcttggattttatgcgctgctctatatgtatatcggctacatcaacggctgtttccgcaaaatgttttacccggaagacttaaagctgcccatgcttttgattgccggcagtgatctgggatgcaatctgttgatctactttttcttgtttttgttccgcaatcgttatcattttcaatattatctgtggaacatcatgttgccggaacttgtctacaccatgctgattacgatctttttgtatgtgattatcctgaaagtcaaccagcggcttgagacattggaaaaaaggagtgcaagtaagtttgtttgagaatataaaagaagttttccgcatgttttttaaatcgagacttgccgttgctgccgttcttatgacggtgctgttcggtgtgcttttgtggcgcgtgttctacctacagatcgtaaagggcgagaaatatcaggacaactacaccttaaagatcgtaaaagagcggaccttgaacagtacgcgcggcaatatctacgaccgcaacggcgaactgctcgcatacaatgagctggcttattcgatcaccatcgaggacaacggcagttacagcagcaccgataagaaaaacgaatcgttaaacgccgagattgcccaggttatcactgcactggagaaaaacggcgatgcgatcaccgatgattttaagattgaccgcaccggagagggtacctacgaattcaatgtcacaggtacctcgttaaaacgtttcctggcggatgtttacggcgagagcagttacgatgatctcggcatgaacaaaaagcttggctacgacacctcccaggcgaccgtggatcaggttatggactatctccgcaacgactgttacggcatcgacgacagctacagcgacgagatggcgttcaagatcacgatcgtgcgttttgccatggcgcagaatgcctaccagaaatatatcgcaaccacgattgcgaccaacgtatccgaagaatccgtggcgtacatcagcgagcacgcacaggaactgcagggcgttgaggtgatggatgacaccatccgcaagtacaataacagcgaatattttgcctccattctcggatacaccggtaaaatttcttccgaggaatacgccaaattatccgagacggatgacagttataccaccaacgatgtcgtcggcaagggcggcattgagcagtatatggattcctacttaaagggtgaaaaaggctacgaaaagctgtatgtcgactatctcggaaaagccatcgaggtgattgaccgcaaggagtccaaggccgggaataatctgtacctgtcattggacagtgatctgcagattgcggtatacaatcttttggagcaggagattgcgggaatcgtgtattccaatattgacaatccttcttccgatattccgatcccgatcacagatgtctactttgcgttaatcaataacaacgtcatcgatctctcacactttgacagtaccgacgcatcgacggcggagcagtcggtatccgccattttttccgcacggcaggacgtggtaaaaagccagttgagagagcagcttaccggcaacacgccgacggattttaaggatctcagcgaggaggagcaggattatttcacttatattatccggagactccgcaaaaataatattcttgccgacagcaacatcgatacctccgatgaggtctaccagcagtggcagcagggggagtgcagtccgaaagattatctaaatcacgccattgcccagaactggattgacattacccagtttacggtggatgaaaaatactcggattccacggaaatatatgatgccctgtgtaattatattctggaagagcttttctatgaaatagatttttccaagatcatttatgaatatctgattaccggcgggcagatttccgggacacagctctgtctgattctgttcgaccagggcgtgcttccgtacaacgaggaagagattgcagcgttaaacaacggctctgtgacagcggtatcgttcttaaaggaaaagatacagaatctggagatcacaccagcccagctggcattggatccgtgctcgggatcgtgtgtggtcacgaataccaagacaggagaggtgttagcgcttgtcacctacccgggatatgacagcaaccgtctggcaaacaacgtcgacaccgaatactttaacagtctgcaggatgacaaatcactcccgcagtacaattacgcgacccagcaggagaccgcaccgggatctaccttcaagatggtaacatccacggcaggtctggcggagggcagcatcacaatcggggagcgcatccgtgatctcggcgtctatgagaacgtaagcaaccatccaaaatgctggattttttcatccaacggcggaacccacggggagatcaatgtctccgaagcgcttcgtgattcctgtaactactatttctacgaggtaggataccggcttgccacgaacaattattccacggcatataacgattcgctcggcattgaaaagcttcagaaatacgcgagcctcttcggtttaaacgaacgcaccggaatcgagatcgaagaagcggcgccgcagatcgccaatgaattcccggtcatggccgctatcggacagagtaataacaactacaccacggtacagcttgccagatatgtgacagccgtcgccaatgagggaaccgtctaccagtatacactgttgaaccgcctggaggattccgacggaaatgtgttacagacatttgagccgcaggtgcgcaatcagatcgacgtgcttgatacggaagagtggaatgccatccattccggtatgcgcatggtggtggagaatacaaaagagtttgacggttttccgatcgaggcagccggaaaaaccggtacggcacagcagaatttaaagcggccgaaccacgcattatttgtgggatatgcgccttacgacgatccggaaatctcgatcgcgacgcgtatcgcatacggttatacctctcacaatgcggcgaaactcgcccggaatgtatttgcctactactttaatgtcgagaatgaagatgaactgttaaacggtcaggctgcaaacggcaattcttcatccaacgagatcagtgattaagagagaaaggcgcagacaatgagtcaggcagtcattatcaaaagcagtaaaaacggaatcaatctggtgctggatgcatcgatgccgtttccggaactgctcacagaaattcttcacaaatttacggaggcggagcgctttttcgcgaacgcatcgtttgccatctcttttgagggcagagaattaagcgatgaagaaaaataccagatcgtagacgccatcatggaacagaccagagtcaaaatcctgtgtattttagacagtgatgagatccgtgatgcggtgatcgaacagaaatgccgcgagatgcagcagacaaacgaagagaaagaggcgagaagacagagccgcggctgcttttaccgtggctcccttctgccgggagagcgccttgagaccgaggagagcatcgtcatcatcggcgatgtcccgcaggaagcggtggtggtatcccaatcggatatcgtggtgctcggcgaactctcgggaaacgcctttgccggaatgagcggcaataccaatgccacgatcacggcgctttctttcctgcccgagcagtataacattgccggcgtttacggcagtccgatggaaaaagcaaaaaattccatcttttccaagcgtaataagaccacacaggcgaaaatggctttcctctgtgacggtattattaatataaggtctttctcgtaaagactataaaaacaggaggtcttccatgggtgaagtaattacgtttacctcaggaaaaggcggcgttggcaagacgactacaacagctaacgtcggtgcgggactttcactgttagataaaaaggtggtattggtagacaccgatatcggcttaaggaacctcgatgtagtcatgggactggaaaaccggatcctctataatctggtcgatgtcctgaccgggagatgccgcgttaagcaggcgctgatccgggacaagcggtatccgaatctctggatcataccgtcttcgtgctccggtgactccaaaaacaatctgaatgaaaaacaaatgaaaaatctgctgtcggacctgcgaaaagaatttgattacgttctgattgacagtccggcgggaattgacggcggttttaagctggcgacggcggattccgaccgcattattgtggtcacaacgccgcagattgcggcgattcacgatgcggactgtgtaatccagcttctgcaccggaaaaaggtgccccggatcgatctgctggtcaacggttaccgcagacagatggtgcgtgacggcaacatgctcgatattccggatatctgtgagcttctggaagcggagcttctgggtgttgttctggaagacgaggagattatcatcagccagaaccacggggaaccggtgatcgggaagcatacggtttccgacacctgttaccagaatattgcacgccggattgccggcatggaagtcgcaataccggattatcttcatcacaaagggatgttctccagattcttctggcggaatcatgccggaaagctggtgtaggatgtgtcatagaagcaagggtgttgcaaaagagcggctgaagctgatgatcgacagccgcaggaaacagctggatgacgagaccctggcgcagatccgccacgaaattggcgaaatcgttaccagatatgtcgatattgaacccgaaaacgttgaaattaaaatcatacttaaggattacatatgttcaaacaatacaaactaaagaattacaagttcatattgattgcactggtggtgatcttaaataccatcggtgtggcgctggtgggaagtgcaagcccgggcgaccagaaaaagcagatcatcggtatggtatccgggatcatcattatgcttctggtatcctatattgattataattttatactgcgtttttcctggctgatctatctgggagccatcggtcttctggggcttgtcattgtggcaggagagcagagcaagggtgcgcagcgctggttcaagatcggcggatttcagttccagccgtccgaactggtcaagattctgatgatcctttttctggcttactattttatgcggtacgaggaaaaaataaattccccgcgggtgctgttcggatcttttatgctgatcggcattccgcttgcccttattctggcacagcccaatctttccacgaccatcgttctggcgctcgtttttgcggcgatgctgtttgccgcggggctcagttataagatcgtggtgggcgtgctggccgtgtgcgttccgaccttttttatcgtattgacgttaatcattcaggataagtttccgtttatacacagctatcagctcggacgtattatgggatggctttatccggataaatatccggatattgcctaccagcagcagaactctatcatggcgatcggttccggccttttgtggggaaaaggactcggcaataccgatcctacctccgtaaaaaacggcaagtttatactagagccgcagaacgactttattttcgccgtagcgggggaagaaatgggctttgtgggaacggtcaccattataattctcttgcttttcattacgattgagtgtatatttattgctagaaaagcaaaagatgcggcgggcagactgatctgctgcggcatggcggcattgattggatttcagagtattgtcaatatctgtgtagcgacgggattactgccgaataccggtgttacgctcccgtttgtcagctatgggcttacgtcgctatggtcattatatatcggtatagggcttgttcttaatgtaggtctgcagccgaaaaaatattaacaggggggacttaaattatgaacatcggattgattgcacatgactcaaagaaaaaactcatgcagaatttctgcattgcttatcgtggaattttatgtaaaaacgaactttatgcaacaggaacgacagggagactgatcgaggaggtcaccaacttaaacgtccacaaatatctggctggacatttaggcggcgtacagcagctcggagcacagatcgaacacaatgagatcgaccttgtgatctttctgcgcgatcccctgactccgaagtcccatgagccggatgtcaatacggttgtgcgcatctgtgatacccacaatattccgcttgcaaccaatctggcaacggccgagttgttaatcaaatcactggacagaggagacttagagtggcgtgaaatgtataaataaatggatctgtctgtcccttctgattgcagtttcctgcgtcagcggatgcggcaagacgtcagctgccatcgaacagccctatgacgtgtatgcaaccgcagcggatttcgggttgtcctcgaatggcaccgcagaggcaaagtcttattttgcgagtaatctctgcgtttcggaagatgtggcgatcggaacggattccacggattcccaggtggcagagggcgcaggcacgtttaatcttgagacaaataccgtagtgtatgccaagaatctgtatgagcggctctatcccgccagcaccacaaagattctgacggcgtacattgccttaaaatattgtgatgatctggacgctatggtgacggtcagcgagaatgccgtcaatcaggcatccgattcttccgtctgcaatttaaaagccggcgacgtgatccggcttcgggatttactatacggtctgatgctgcgcagcgggaacgacgccgcagttgccattgcggaatacatatcgggagatgtcgattcgtttgcggctctgatgaatcaggaggcggcagcaatgggggcgacaaggtcccattttgtcaatccgaacggccttccggatgagaaccattacacctgtgtctatgatatgtatctgattttttccaatgcgatcaaaaacgatacctttgtatccatcatcggcacaacctcctacgatgttacctataccgacgcttccggcgaggcagtgacccatacgtgggagaacaccaatcagtatctgaccgggaatgcaaccacaccggacggatttcagattgtgggcggtaagaccggaaccacgggcgaggcgggctactgtctggtactgtattcgtataatccatccggccagccgatcatatcgatcgtattcaaagcggacggtaagtccaatctctatcttttaatgaacgaaatgctgcagggattcgccatttagacggcggatccctgattgtttatatttatttgaaaattggttgtattttatgtgcatatagactataatcaatttataaaatcaactgcttttatacatattaacggattttgtgtagaaagcagcatcagcaggaggaaatgactatgatagagattatttcaggcgaaaagggaaaagggaagacaaaagagcttttgaccaaggtaaatgctgcggttgcctctgcatccggaagcattgtataccttgataagagtcagaagcatatgtacgaactcagcaacaagattcgtctcatcaatgttaccgattatccgatcgataattgtgatgagttcctcggatttatctgtggtattgtttcacaggatcatgatctggaagaaatgtatctggacagctttcttacgatcgcttccgtagagacggatgacgagatctgtcatgcaattcagaaactggatatcatcagtgaaaaatacaacgtaaaatttgttttaagcgtctccaggaacgaggcatctcttccggattgcgccaaagcaaaaattgtcatttccttataaaatgtaaaatgccgtaagaaaagtgctgtagcgatacagcactttttctttgccggcagggacttcttatgcctgatcgacagagcggatgcgcccgaacaggctgatcagatagagaccgccgagtccgacaagcgcatagatgatccgggagaaccatgacatattgccaaaaataaaggcaacgaggtcaaaacggaaaaatccgatcagtccccagttaatggctccgataatcaccagcgtaagcagtgtataatccaaccaatttgtattcattttctatgcctcctttttctatcatagtatggacatgctgcgccggttttattctgctttgccggacttgttgttcactccgggaacaaatcccgaatttattgccgctaaaaagttgttttccagggctgaaaatggtagaataaaaatgttgaatttgaaaaaaggtggggcattttttgagtaaaaataaaaaagtggttcgctatcgcaagccgtttaatgtcaatatcggaatgatcatttttattattatttttatctatctgatatttaacattttctcctacatgacgacggagcatatttccacgtatgaagtagagcagggcacgatggcagaaaataatatataccgtggactgattctccgccaggagcaggtctattcctcggatacggcgggggcgctgaatgtatatgtaaaggaagcttcccgggtgggttacggaaatctgatctgctccgtcgatgaaggtggcagtgtgtccaagaaaatcgaggaggcagccggcaacgcttccaatctgagtgcgcatgatctctcggagattgaggattccataagcgaatttcagatttcctacagcgcccagaatttttatagcgtttccacgtttaaggaagatcttgactctgcactgaatgaatccttgagccttgccgcgctggacggaatctctgattacgccgcggcggcgcaggcagaaaatacatttcacacctatcatgccgatcagcccggcattgtcgtctattccaccgacgggtatgagggcgttaccacggatacgtttcagtcgtccatgtttgacgaggcatcctacgaccgcacggacggtcagcgggcactgcaggttgcggcaggagcccctctgtataagctgattacaagtgaatactggtcgcttgtcattccaatcggctccgatctggcaaagcggctggcggacgatgataccttgcagctgcgttttatgaaggataacaccacgacctatgcgacctataccatcacggaaaaggaaggttccacctatctgattctgacgcttcgctcggggatggtgcgctatgccaaggatcgctatgccgaggtggagctgctgcttagtgaggagaccggacttaagatccccaattccgccatcacggagaaggaattctataccgttcccaaggatttcttcatgaaaggcggcgattccggcagtctgggcattctggtgcagaggagcgattcctccgggaaagcaggggcggagttcattgccccgaccatctactatgagacggataccgattattacatcgacggtgaggaggttggcgcttcggatatcatccgaaaggcggattctacggagacgtaccagatcggttccggcacggcgagcctgcagggcgtttataatatcaataagggatatgccatcttcaaacagatcgacattctctatcagaatgaggaatacgccatcgtgcggaccgggacaacctacggaattgcgctctatgaccatatagcgctcgacggaagcaaaattcacgaaaatgatctgatcaattaaacggaggaaatagatatgttaaaggaaaatttaaaaacagtggaagagcatgtacaggaggcttgtaagcgtgcaggtcgttcccgcgaggaagtgacgttgatcgctgtcagcaaaacaaaacctttggaaatgctgcatgaaatctacggggagggcgtccgcgatttcggagaaaataaagtgcaggaactgtgcgataaaatggagcagctcccgtccgacatccgctggcacatgatcggacatctgcagcgcaacaaggtcaaatatattgtcggaaaggttgccctgattcattcggttgatacataccggctggcagaagagatcaatatccaggcaaagaaacgcggcatcatcgtgccgattctggtggaagtcaatatcgccggcgaggagaccaaattcggcacaacggcagaagatgccatgctgcttgtggaagagatttccaaactggaaaatgtgcggatcaagggacttatgacgattgcgccgttcgttgaaaatccggaggataatcgcctttattttcggaaaataaagcaattatctgttgacataacaaataaaaacatagataatgtatctatggaaattctgtctatgggtatgacaggagattacgaggttgccattgaagaaggagcgacgatggtgcgtgtcggaaccggaattttcggtgcacgcaattacaaaaaaagcaatgaatcgcattaggagtataacatgagtgttttagataaatttttaaatgtcatgcgtcttaatccggacgatgacgacgatttttacaatgaagattatgattacgatgatgattatgaagaggatgaaccggtaaaatcgaagagttctttccgcaaggacaagaagaaggcggaggaggatgattatgaagaagatcattctatccacgagaaagccgtcaagagttctccgaaggtcacaccgattcgcccggtcaagaagcagggaggaagcggcatggaagtatgtgtcatcaaaccaacctcagtggaagatgcccgagagattacagagacgcttctcaataaccgcacggtcgtattgaacgttgagggactggacgtcgagatcgcacagcggattatcgactttacatcgggttcctgctttgcaatcagcggtaatcttcagaagatctccaactatatctttatcattacaccggcatcggttgacatttccggcgatttcttaagtctggtagacacgttccagtcgacacgcagtgtccagaccgatttttagagtctatgaacgaacaggatctttgtcagaagcgtctgcttgatctctccagacaggcggatcgcaagggaatcgttctattcagcgatttcctcaatttaaatgaattgaatatataccaccagtccgagaagctgtttgcgacgaggaccgaatgttttggcggtattccatgtgcagagcgtcagatgattgcctttcttcctgatgctctttattatgattgggaatatcccatttccgctttaaaaatcacaccggcttatcccaaatttgccgagaagcttggacatcgggacatcctcggatcgctgatgcagctgggcgttgaccgctgcaaattaggcgatattctggtcggggagcaggaagcctatctgctgtgtgaagagaccgttgcagactattttgcggagcatcttgaaaagatacgccacactctcgtaaaagtcgaaccgtgcagtctgtcagaccttaaggtgacacaggaattccagacacaggacggaatcgtaacctcagaccggattgacgccgtcgtcgcgtgcgtttaccatctgtcccgcagtcaggcgtcgcttttgctacgccaggagaaggtttttgtcagcggaaagctgatacagaatccatcctatacctgccatgcggatgatattatctctgtccgcggttacggacgctttatctaccgaggggaatacggaacaaccggaaaaggacggctcaaaatacattacgacctctatgcaaactgaaaggagtttttcatggcacaatcgattccagtaaaagcaaacgacagtatcatttatcatattgaactggttcatgatttttcaatgctccctacgtttctgcagcagctgggatacggacgcacacagaaaatctgcattgtgaccgattccaacgttgcgcctttgtatgcgagggacgtacaggatctgttggaaaaagagtttgacacggtcattcttcatacgtttgaagcaggagagcacaataaaaatctggagacggtaaacactttataccagactctgatcgagcagcattttgatcgtcaggatctgcttatcgctttgggcggcggtgtcgtcggagatcttaccggttttacggcggccacctacctgcgcggcattgattttatccaggtgccgaccacgctgctttcccaggtagacagcagcatcggcggaaagaccggcgtagactttatgcagtacaaaaatatggtgggcgccttttatcagcccaaactggtctatatgaacctgtccgtcttacagtccctgccatcccggcagattgtttccggaatgggagagattataaagcacggtcttatcaaagacgacgcttactatgaatggctgatggcacatcacgatgccattttggcactggagccagcagtcatggaagagatgatcgcccgaagctgtgatatcaagcgcgaagttgtagagcacgacccgacggagaagggagagcgtgcgctgttaaactttggtcataccatcggacatgccattgaaaaattgtgcggtttttccctgtatcacggagaatgtgtagggctcggaatccttgcggcggcgtatctttcccaaaaacaggggaacctgacaaaagagcagcttgccggcatcagtcagtgcctggctgcctttggatttcagacacagatcggggggatctcaccagatgctgtgttatctgccaccaaatccgataagaaaatggtcggaagccaggtcaaatttattctgctgcataccatcggagatgcttatatctaccgcgagttaagcgacgcacaaatcctggacggcattcgttatgtatgccgggcgtaatcccggcctgacagtgaaaacaacacggaaggacaaacctatctatgaaagatcattcacctattttgaaacgcaatctgaccggctgtgtggcggccgtgctcctcattctgctcgatcagtttaccaaaatgcttgcggtagcgcatttgaaggatcagccgtccaacgtactcatagacggcgtgtttgagctgcgctatctggagaaccgtggttccgcattcggaatgatgcagaataagctgattatcttgattcccgttaccgtcgtggtaacgttacttattctgtatctttttttcaaaaaacttcccgccacgagacactttttctggctcaatgcgattgccgtactgttttttgctggagccatcgggaatttcatcgaccgcgtcagacagggctatgtggtagattttttctatttcagcctgatcaattttccgatctttaatgttgcagatatttatgtgacagtagcggcatttttattgatctttttatgtctgttctattacaaagaagaagattttgaacagattttcccatcgggttcttccagacaacattcttcggagaaaaaagacaatgactagagaaacatttgaagcgggaattgcatatgagggagagcggctggacaagtatctgaatctcattttcagcgagacagatgcggcgcagtcgcgctccttttttcaaaaactgatcaaagaggggcatgtgcttgtcaatgatacggcgcagaaagccaactaccggttaaaggcagatgatatgatctgcgttgagattccggatgcggtacagacgccgattcttccggaaaatattccgcttgacattctctacgaggatgacgatcttttagtcgtcaacaagccgaagggaatggtcgtccacccgtccgccgggcattataccggcacgcttgtcaatgccatcatgtatcactgcagggacagtttgtccggcatcaacggggagatccgcccgggcatcgtacaccgcatcgatatggatacaacgggttcactgattgtatgcaaaaatgatgagagccatgtctttattgcggagcagatcaaggaacattccgtgaaccggcgctaccgcggcatcgtatacggtgtggtgaaagaggaagagggtaccgtcaatgcgccgatcggacgccatcccatcgagcgcaagaaaatggcgatcaatgagaaaaacggcaagcctgccatcacccattacaaggttctggaacgctttgagcggtacacatacatggagtttaaactggagaccgggcgcacccatcagatccgcgtgcacatggctagcattggtcatccgctgcttggcgacacgctgtattccagcggaagaagtccctataagctgcaggggcagacgcttcatgccatgacgatcggcttcattcatccgagaaccagagagtacatggaggttacggcgcctcttccagaatattttgaaaaaattctaaaagatttgcgataatttcaaaaaataattccgtttttcaaaaaaatgtattataatatattcatagaatgttaggaaaggcgggatcttttatgggcaacaaaatctataccattggtcgtgaatttggcagcgggggaagagaaatcggcgaaaagcttgcggaacgtcttggaattaagctctacgacaaagaattgttacagcaggcggcaaaggaaagcggtttctgtgaggagattttcgagaatcatgatgagaaaccgaccagcagctttttgtattccctggtcatggatacatattcgctgaacggctatcattcggcaccgtttctcgatatgcctttaaaccacaaagtgttcctggcgcagtttgacaccatcaaaaagattgcagagcgggaatcctgcgtgattgttggaagatgcgccgattacgcattatcagacaatccggactgcatcaatatctttattcatgcggacatggacaaacgcgttaagattatcagccaacgcgccaatattacggaaaacaaagccagggatctgatccagaaacaggataagcagcgtgcaagctattataactattatacgagcaaaaaatggggtgattcccagagctatcatctgacattggactccggtaaactgggaattgacggttgtattgatatgatcttaaagtttcgtgaaatcctcgatgcatccagataacatcatcggctaatatcatacaacgtgaacgaaatggtttcaaatggtttcaaatggtttcaaagaggcggcacttatttgatttaaggtgccgcctctttatgtctgcgcaaacaaacaccggcaaaatgcaggaaaaacgcacatattccttgaaatgcgggcggcagtgtgctatagtagagatacagatatttattcgcaaaacacaagtttaacgaatagtttctaccataaaacaaccataaagctgttttacgctgtgccggatgttttacgggttctgttttaacagatctcttcggaatccagcagaatggtaaacgggccgtcatttaacagagagatcttcatatccgcaccgaaaataccgcagccggtatctggaatctgttctttgcaccgtgcgacaatataatcatacatccggctcgccatttcgggcttcccggcacggacaaaggaaggacggtttcctttgcggcagtccgcatataaggtaaactgcgagatcagcaaaagacttccgccgacgtccgccaacgatagatttgtttttccgtccgcatcctcaaaaatacgaagccccaacagctttttgatcattttatcggcgattgcagtcgtatcggtatcggcaattccgatcagaaccagaaatcctttttgaattgcgccggtgacattgccgtctaccgtgcaggatgcctcggttacacgctgtattacaaatttcattttatcaatctcctttttgaattatttgcttcgttgatcctaaatttcatttcatgatagatcatttcatgacagataattttattataaaatagttacgaggtgatatgcaatctatggaattaaaaaaacttttaagctatacacgccaggcggttgacgattataaactcattgaggagggcgatcatattgcggtcggtatttccggcggcaaggactctctcactctcctctacgcgcttgccggactcagacgcttttatccgaagaaattcacactcacggcaatcaccgtcgatctgggatatgattcttttgatcttactcccataaatcagctctgcgaggaacttaaggtaccgtaccacattgtaaaaacagagattgcacgtatcctgtttcacggcgacagcgtgtcggacaaagcagtcaagggatctccgtgtgcgctgtgcgccaaaatgcgcaagggagcactcaatgaggcggctctggaattaggatgcaataaggttgcctacgcacatcacatggatgatgtgattgagacggcgtttctttccatgatttttgagggaagattctatgcgtttccaccgagcacacatttagaccgcacacagcttgtggtcatacgccccttactatacgtctctgaagcggaagtaaaaggatttcggaataagatgaagcttccggtcgtcgccaatccatgttctgcagacgggcacacacagcgtgcttacgtgaaaaatctgatccgacagatcaatctggatcatcccggagccaaaaaacagctttttcatgcagtattacatggaaatatccccggatggcagacagacgtcgctgaggaaaaggagaattcaattcgtttatgaaagaaaaagcatattatgaaaatgtgaatgtaaaaaatgaagtaaaattgcgcaagcttctggaacagcttccggatttctgcaaacagtttttcattggcattgagccaaccacttcctcgcgtaccagaatcgcgtatgcttacgatatcggctgtttttttgactatctctgcgatgtgaatcccatttgccagaactataccgtaaaggatattccgctctcgcttttagacgagctcacgcctatggatatcgaggaatatctctcctatctgaagtattacgaaaaaaacggtgtagagcacacgaacgacgagcgcggtatcaagcgaaagctggcctctctccgctccttttaccgctactatttcaaaaacgacctgataaaaaatgatccggctgtgaaagtggacatgcccaagattcacgacaaaaatattatccggctggatatcgatgaggtcgcgagactgttagacgaagtcgaatccggtgaaagtctgactccacgccagcaaaaatatcacgaccgcacaaagacaagagatctcgcccttatgacgctgctcctcggaaccggaatccgtgtctcggaatgtgtcggactcgatctggaagacgtggatatgcgcaataacggcatcaagattcaccgaaaaggcggcgcagaggttgttgtatactttggggaagaagtacgcgaagcacttctcgcttatatggttgagcgccagaaaataaccgccgaagacggcagtatcaacgccctctttctctccttgcagaaccggagaatcagcgtgcgttcggtcgaaaatctggtcaaaaaatatgcaaaactggtgaccagcttaaagcatattacaccgcacaaactgcgcagtacctacggcacctccctctatcgcgagacgggggatatctatctggtcgcggatgtactcggccataaggacgtcaacacgacgcggaagcattacgctgccatcgacgatgatcgacgacgcagcgcagccaaatatgtaaagctccgtgatgtctagtgttccccggagatgcatccatcgccttaagtcctatcagatccgtggctctggcaagactctgacaaacaaaaagctgtttataaaaaaagcagctcacaaagaagctccagtcatccgaccggagcttctgctggcttaagaacttcatctagcttttcctggatacgtaccttcaccagatccgcaatctcatgcgttttgagaccgccatattcatcgtataagatcggtttcagataatgtacctgcgtggtgaccgatcccaaacaaaagctgttaaaaactttataagaatcaatcagagccaccggtacgatcggtgcctttgtctttaacgcaatcttaaaactgccggctttaaaatcacacacatggttcttattgttaaattcgtatccgccctccggaaacagaatataacgctttccctgctttacttcctcggatacctcattgatgatcgtcaatgcctgtctgacatccttcttatccagccgctttccctgaagcagatccacaaattcacgaaccagtatggtattggacttcgccttatccatcacaagcgaacatggctccctgtgggtgtagataatgccgagtgcgtcgtactttccctgatgattcggatacatcatgtagccgccttctgtcggaagcagctctgtgccgtaagattttgtgtggatgccgccggttaccttcatcaggcgaatcacatggcgcgccagcgcgtagcgctcctctacactatacttttcaggatgatccgcctccctgcgcatcttcggtatcatataaggcgctctgaaaagattcattaaaatcacatagataaactttatcatacgagataactcatcctccgtaattcatattctctgtgctgccttcccgcacaatatgagctcgtcagaattcattataccgtacttacccaaaaaacacaaccgaccggagacgctgcacaaaaaataccatcttacttgagatgttctgccgaataatacgggatggtcagatactgtccggaatgaatgtcccccggcaggatgtgattgatcgcacagatctcctccatatattcgtccatgctgtcgtaatcgtctgtgatatattcatctgcgatattccagagggtatctcccttctggatctggatgcttgtgtaatatttataagaaggttctgcaggagccgcctgtgtgcggatcgttcccagcaggacagaaccgatcacaatgacggttaaaaccatcaatcccaacatgaatgtgcgtctctgcgcctttaccgctgctcttctgcttctcataagaatacctcctgtcatgttaatcgaacgttcattccgaacgtttgttgcgaacatttgtttatgttcctatcataataccagaacatccgtttgtcaacaagaaaatcgaacaaattttcggaatatatgtttgcatttttacgcatgctgtgttaaactaaattatacataatagcattggtaatgattgacaggaggtatatgcatggcatacggcaagatcagcacgaagcagagagagattctcgaatacattaaacaggagatattgaataagggatatccgcccgctgtgcgtgagatctgcgaggcagttgacttgaagtctacctcctccgtccactcccatctggagacacttgagaagaacggatacatccgccgcgacccgacgaagccgcgtgcgatcgagatcattgatgataactttaacctcaccagacgcgaggttgtcaatgtcccgattctcgggaatgtggctgccggtcagccgttactcgcagtcgagaacattgagacctacttcccgattccgaccgaatttctcccgaacgcggagacgttcatgttgagggtaaagggcgaaagcatgatcaacgtcggcatcttcgacggagacaatgtgctggttgagaagcagtcgaccgcgcgcaacggcgagatggtcgtcgcgctggtggaggattccgctacagttaagaccttttataaggaggacggttatatccgccttcagccggagaatgacacgatggatccgatcattgttccagattgccagattctcggaaaggtcattggtattttccgttttctttcctgatgaagttcggtattcctggaataaaatgcagattcctattataatgtacaagaaagaatcctgcttttcaggattctccgcctgcggcgggttgctctagcgacatcgcgcgagtgcacatccctgcggagcttttctatgtaacaggaacgaagtttcctattatatagaaaaaagtatgccccctttcctgtcagccagaagggaggcatactctttttacgacactcttaagttcaaaacacgcatctatgacctttccgtctctccggaatcttacggatccgccgcatctatgacctttccatttctccggaatcttacagatcagccacatctacgatctttccgtctctccagatacgctccagatcatagaataaacgatcttccttggaaaaaatatggacaatgatgtcaccgtaatccatgagaatccaggtagaactggaatttccctcgatctgtttggtcttaagtcccgctttgtataatgcctcttcgcaggcatcacgcattgcctgaatctgattctgattcgttccgtccgcaatcacaaaataatctgcaaccggtgaaatctcacggatatcaatgatcttaacatcctccgccttgcggtcttccaaagccgctactgctattttacaatattcctgtgatgtcattgcatgtttcctttctatctgttctttgttcgttttaacaggtaatccgtcaaaccggatctgtctgttccttctggtactgccggtagaattcataggcaagctgtgtggagggatctaacggtccgccgaccctggagcggtatttcaatgtgtcgcagagaatctccgccatacaggcatccagatcttcaaatgccagtttccgcaccctcggcagatctgcggccttgttccttcccggctcgatataatccgcaatatagatgatcttatcgagcgtactcatatccggcgcgccggttgtgtgcaccttgatggcgtgcaggatctcaggatcttttacttcatagaccgtctctgccagataagctcccagcttggcatgcagcagaaacgggctctcatattctacggcattgatgggaatgtcatgttcctcacagatctgaagcttctcatcgtccggaatacatttggcacaatcgtggagcagacctgcgagcatcgcctgctcgatcgatgtctcataagccatcgccatacatccggcggtatacatgacacctttcgtgtgctcataccgtcccttatccaactctttttttaatcgtttacgaatctcatgctgttccatttttattctcccaaattcgatacgccgtacagatgatagcgtttgatcagctcccacacctcgcccgggagcatggcgggacattcacctgtcatgcggatctgtgcgcggattgccgtcgaggagacatcggttcgtccgcccgcaagcggatagatctcagccggaaacaacgccttgatgcgccgtatttttccctcaatctgcggcagttctaaggtatccctgaccgctgcaagcacggtggcattctgacagatgatctccggatgcctccacttgtcaaagtagtccagggaatcggctcccatgataaagaagaattgatcctccgggaactgttcctttagatgctgcagcgtcttatacgtataacttgtcccggaagactctatttctatacgtgaaagcttaaatgacgcatcatttttgatggccgcctgcgtcatttccgcgcgcacctgcgcgggtgtcatctccgcctcctccttattcggagagtgccctgccggtatgaaccacacctcgtccaacgcgaactcccggtaggcgctccttgcaatattcagatgtccctgatgaatcggatcaaacgagccgcctaaaattccgatttttctcatgccggaagttcaaacttgctgtttttcttcgcctggcggaataagatgatcttcttgccgataacttttacaacagcagaatgtgtgcgctctgcgatgacctgtgcaatctcccgcggatcatccgcacaattctttaatacggaaatcttaatcagttcccgtttttctaatgcttcatccagcgcctggataatctccggtgtcaggcttgccttgccgatctgaaagattggatctaaggtgcttgcacatccgccgagataggcgcgctgcttacttgtcaattccatatcctgcttcctcctctttacttataataatcaaattcaaaaccgtacatgcgcacggtatcgccgtcctcaattccctgtgcctccatgtcttttaaaatgccctgctccttcatgaacttctggaagaaaaggaatcccttctcggaatccatattcgtatagccaagcatcttctcgatcttcggtccttccacaacgaatgcaccgtcgtcagccaccgtaatcgtgtatggctcatccttaaagaaacggagtgccggatcgaattcaggctcatagacaaccggctccttgctgcactggtcgagaagctcgctcacgcagtacaacagttcctttaatcccttgccgcttacggcagaaatcgggaacacacggattccgtctttttcaaaggtgtcttttaacttctggataatctcattctcgtccccgtagaccgcatccattttatttgccgcgatgacctgcggcttttttaacagtgccggatcgtaagcttccagctccttgttgatcgcgataatatctgccacaggatcacgtccctcggtgccggcagcgtccaccatgtggatcattaccttcgtgcgctcgatatggcgcagaaattcaagtccaagtccaacaccctcggaagcgccctcaatcagtccaggaatgtcagcaatgacgaaacccttcgcgccgtctaaatccaccacgccaagattgggctgcagcgttgtaaaatgatagttggcaattttcggctgtgcgttggtcacgcgcgataacagcgtggatttcccgacattcgggaagccgaccagaccgacgtccgcgattacttttaattccagcttgacttcaatctcgatcgaatctccgcccggctgcgcatattttggtgcctgcatcgtcgatgtcgcgtaatgctggttgccaagtccgcctctgccgccccgcagaatgacctgtctgcggttctctccggacatatcggcgatgaccttgccggactctgcatccttgatcacggttccctccggcacctttaagatgagatcctcaccgtttttgccgtggcagttgcgcttgccgccctcttctccgggctgtgccgcaaactttctgcgatgacggtaatccgtcagagtgtttaaaccttcatccaccacaaagatcacgtcgccgcccttgccgccgtcgccgccgtcaggaccgccatccggcacatatttttcacggcggaagctcacatgcccgtcgccgcctttccctgattttatgataattgttgctctgtctgcaaacattatattctacctcaattcaacttcaggcagcagatgctgccacctaccgaacggttacaaatccagatacaagaagacccggctatagacgcctgccatcaggtaagcgctgcatagtcgggtctacactctgcatcttattactcagctactggataaacagaagcctgcttcttgtcttttccttttctctcgaatcttaagataccatctgtcagtgcgaataatgtatcatcaccgccgatgcctacattaacgcccggatgaatctttgttccgcgctgtctgtataaaatgttgccagccttcacgaactgtccgtctgctctcttagcgcctaatctcttagactcagagtcacggccgttctttgtagaaccaactccctttttatgagcgaaaaactgaaggttcatattcatcatgttctacacctccctaaaattcagaatgatataatcattcccataagtattctgtattccctgcaggccaagtaccagcgactgcatcagcaatccggcatcgtgaccggccggtgaagtaaatcgcaggcgaatctcgccatcgtcttcgtcggcatccgtctcgcatggttcgtcggtaaacagcccgatggaattgatcgtattgataaccagtgcagaaattcccgcacatacaatatcctcgccttcatcggcatacccggcatgtcccaggcagtcgaagcccaaatactcaccgtcatgattgcggaaaatcgttatctttgtcataacaaccttccaggattaagcgttgatcttctcgatcttaacctgtgtaaacgcctgtctgtgaccgttcttcttgtgatagccggtctttctcttgtacttgtaaacaataactttcttggatcttccctcttttacaacggaagcctctacagatgcgtttgctacatcagaaccaaccttaattccgttgtcggatacagctaaaacctgatcaaaagttactttctcaccagcttctttaccaagcttttcaatggtaatgatatcgccttcggatactttgtactgtttaccacctgttgctataattgcgtacatatggcacctcctattatcattactcgccagttgtggtgtcgcccgggcaatccggacggactttgagacctcactgtgcggcatacttgattataatagcatagcagtttggtttcgtcaacagattttttgacttttttgccaaaattcttgactttttcctatggatcgtgctatactctcttcgctaaaacttggtgtggacttttcaagtctgactttttttcgccacacaatgattcttttgagtcattgtgtggcgttttctgttttatcctggatacaataaacccagactattatataggaggaaataccacatgaacgaaacatttatgaaagaaaaacctatcctgccgctgcttacctccatggcgcttccgatggtcatatccatgatggtaaacgcactttataatattgtagacagtctgttcgtcgccagaatcaatgagaatgccatgacagcgctgtccctcgtcttcccgattcagaattttgtcaacgcgcttgccatcggattcggcgttggtatcaatgcactgattgcctattttctcggagcaggcgacaaaaaaggcgccgaccgcgccgccacacagggacttgttctggcactcatccacggcgttgtcgtcactgtgttaagcatctccatcatgccggctttcctggacatgttcaccaacgatgtgcaggtatatcagatgggaatggagtacgcggtgatcgtatttgcgttttcgacaatcaccatggcgaatctttcctttgagaaaatctttcagtccgtgggacgcatgaaagtatccatgatcggcctgctgtgcggaagtattactaatattatcttagacccgctcctgattttcggcatcggaattttcccgaggcttggtatcgccggcgcagcgattgccacagcgatcggtcagctgtgtaccctccttctttacctgacggtgtacaacaagcgcccgatcccggtcaaaatccgcaaagaataccttgcttttcataaggaaaccgaccatcgtctctactcgatcggagttcctgccatcttaaatcttgccctgccatcgctgttagtatccgtcttaaacggtattctggcagcttactcccagatctatgtggtcattctgggaatctattacaaattacagaccttcctctatcttccggcaaacggcattgtccagggcatgcgtccgctgatcggctataattacggtgccggcgagcagaagcgcgtgaaaaagatctatgagattacgcttgcgatgagtgctgtcattatggcgctcggcacaattttatgcctggtggcatcgcgcggtctgatggaactgttcaccgaaaatgccgagacgatcgcagccggaggaaccgcactgcgcatcattagcgcaggctttatcatctcctccgtgtccgtcacagcctccggcgccttggagggacttggaaaaggaacgcagtcccttgtcatatcgctgttccgctatgtaattctcatgatcccggcagcctttgtattgtgccgtatctttggaccaaccggagtatggcatgctttctggatcaccgaagcagtcacctcggtcatcgccgcttatatctaccataaggcggtcggaagcagaaaataacatctgtcaaaagcatctgcgatgatccgtgtctttccaagtttggaacactccacggactgtgtccgcaagctaacagacaattttaggacttttgtgcgtgccccttgtgccaccactgagcaaaacataaccgcgcgaagccgatgtttgaattggcatctgccatgttttcaatagcagatgccaacgagtttcggttcgcgcggttttatattgtctgtgaagcggtggcactaggggcactaaaaagtccgctcattgtctgtggcttgtcggacacacaccgggagagtccaaacgtggaagagacacggaatcagatgcaaacctccgtcaggaagaaatgctctcatttttttcaaataattgtatcctatgcagttccagctgaaatctacatgctgtgttttctggcatattacttatcgcttcaaaattcactgccctctaaagtaccagcccctttttggacacttcctcctgaaagatcatgcgaagctgccctttcagcggaacattcagttccctcagggtgtcatccaatgcatctaacgtctcgatcatgtccaccacgttcgcattgctacccatgtgtccgatacggatcacctgccccgctagggagtcaaacgatcctgccagcatgataccgtgcttctgacgcatggtctgtaaaatggcatccgcggtcgtctctttcgggacgtcaaacaccgtgacggtattggagaaaccggatgcaaggtgtaagttcagtcccactgcgcggactgccgccctgcatgcctcaccgatccgtgcatgacgcgccagcatatccggatcgcccgcgatattgtcgaacgcggcgcgcagtccgtagatatcactgatcggcatggtgtacggaaaccattttttctcgtaatatccctcaaacaccttaaggtttgcataaaaagaggcaatcggtacacttctgccatcgatggctgcccatgccgcatcactcaccgtcacaaacgtcagtcccggaggcgccgaaacggctttctgggaaccgccgcagaggagatcaatctgaaaatcatccaggcgcacatcctcgccgaacatgccggagacggaatccaccaccgtgagtatcccgtattttttcagaagcggacaaagcgcagagatgtcatttaacatgccgctcggggtatcgcagtgcacgagcgttgcatatttgtaatcgtgatgttcctttaaatattcttccagggcggccggatcaatcggatttttctcatccacggaatacagaaccggctttccgccatacatggaaacgaaatcagcaaaccctctgccgtatacgccgttatccagcaccagtaccggatcgcccggttccgtcagggaggcacaggcagcctcaagccccagaattccctctccgcctaaaatcagggtctcattcccagtgtgcagcaggcggctgatcagttcacaggtctccttataaaaatctacgaaagtttcatccagatccggattggtgcagggaaaactgcgcgccatgcggacattctctttgacctgcgtaggtcccggtgtcataatcttatacatggaaacgcctccttagttccacagttttgcagctactttctttaacggtgcaatgatgataagaacgatcacagctgctgttccgatctgaagcaggttgcccggaatcgatgtcaccggtgtgatccagttgccgtaaataattccctctgcgatgtaatatccgccgatcttgatcgcgcaggcagcaagcattgccacaacataccactgaaagccctgcttcttctctgtaatccatcccatcacaaatcccatgcatccgacgatcacaaaggtaaacggtgcccatgccgtccagccggacaacagatcaaacagtcccatgccgactccgccggcaatggctcccgtctttttgccaaacaggattgcgaaaataaacagtgggacatttccaagatgaatcaatccgccctgcggtgcaaacggcagacgaatgttaatcagccaggtaaatacatataccagtgcgattccgatcgccgtgacggtgagaaaacgcacctgctctgtgctggttgtttttgtgctactcatagttttggtttctgacatgactctttctctctttcttttttgttagagccatgataccccatttctggatgaatgaatatgtccagttttactatttttgaccagtccagttcaactttcatctccggtgaatcccatatttctccggtattcgctcggcgaaacaccgcagcagcccttaaacagtttcataaagtgcttctcgttctcatagccgacggcctgggagatctccgcgatgcgcatatcggttcctgcgagcagccgctttgcctccttcatgcggatatctcttaagtaattgacaaaattacttccggtatactgcttaaacgaataagaaaacagggaataattcatggacagataattagagacaaccgccatattcagatcactggcatagtgttcttcaatgtaggcgaccgcctgcttcattttctgctgattcccgtttgtgtcaaactggcttaaaatctgcgcctgcagaccggtcacaaaggccagcaccttctgttcgtagcagtcgattgcatcctccccgaatgggtctgtaatctctttgatctccccgcagttttctttttcctccagcacattccggtacgtttttgacgtctccgtaaggaaatccgtcatgcactcctcaaagtcccggacaccgatgcggccatgctttacctcgtaaaaaaattgcgtccagacgtgctgcagttcctcggtgcggtcggttccaagtaactgcacccgctgcagtttcatctcgtctgcaaccagctttgacgcctcctgcaccagcttctgtgggacacgcggcatctcctgcccatagcgcatctgactgcggttcgtgcaaaacgcgcacctgcgcatttcccgcgcctccagatatgcctcgcgcagttcgcggattccctgatgcggccggctgattccggtatattcctgcaaaaaaggatattcccccggacggtccgaaagtgcttccgcctcgattaaaaagagatcattttcctcgacatcgcccaggaacaggcagtccttcgggcaggattcctcctcttttttccggttcctgcagcagaccacatacggctttccgctcagatctaaaataaaatgctggtcatactgggtctccaacatggtaagctcctcttccggcatctctgccagaagcatcagatgacggatctgctgctgtccgagcttctggcgcgttttctcctgctccctgccctcctcaatctcctgattcagcctggcaagtatgtcgcagattttttcgcgctcgatcggttttaacagatattcccgcaccccgttgtgcatcatcgccaccgcatagttaaagtcatcgtaaccgctgatcgcaacggtgagcggtatgtgttcacattcctgcatgcgctccaccagctcgattccgtccatctttggcatacggatatccgtaaacatgacatcgatggactgctcttttaaaatctcaagcgccgtctcaccgttgttacattccataatcacttccaccgggacaccgctccgctgaatcatcttgcggagtccctgccggatcagtttttcatcctcaacaatcaatacagtcttcattctgcttctcccctgtgcgtcatcggaatgcggacgataattttggtatagcatccgatctgcgacgccacttctatgccatacgccccgccaaatgcaatctggatccggtcctgcacgttttttaagccgattccgtttccggaacccccgctcgaatccagttcccctgcaatcttctgacgaagctgtgccatctcttcctcggtcatgccgcgcccggcatccgtaatttcaatcacgcagtcgtttccttccacgcgccccttgatgtagatgttggtatcttccgccatctgctcgattccgtgatagatggcattttccacgatcggctgcagcgacattttgggaatctcctgctgtaaaataatctccggcagattgagtgataaatagatctcgtaatcaaaccgcagattgattaacgccatataattcttgatatattccagttcctgctccaccaggacattgcctgatacccacttcatgctgtagcgtaagagcttcccgagggatgtgaccgcatccgaaatatcgtactcctcgtcgatctccgccatcatcttgatggactccaagacattatagataaaatgcgcgttaatctgattctgcagcgcacggatctctgaattttttaccagcatttcgcgctttagattgtcgtccatgagctgcttgatcctcgttaacatcttgttgatctgtgttcccagctctcccatctcatccggtccgcagtgctcgatcaccacgtccagatctccgccctgcacgcgccggatggcgcgcagaatctcgtacagctgttttaacagatgttttacgatcgcattgataaaaaatgtcagaacaaccaaaaacacgagcatgaccgccacaaacgtgttgcgcatgcggtatacgtgatgaatgttggacgtaatatttttcacgcagagcagggttccgtttaattcctgcaagggaaggtaggatacgatcagatgctgtccctgcagcttcagatagcaggtctgtatttcctcgtccgccgtatactgtgccatgatctcggcgagcagttcctgccgtcctgtgttttcgtcctccccgtcaccttctccaaaataacacccgccgtcctctgtcagaaaacagctccactcgtcctcaatgttctcgtagagactgggaaacatgttttccatcgtcatagccgcctcgatcattccgagcgtcccggaatcgctgtcctttatctccgtcacgagcgataagatcttgcggttctgtctcatcgtgtaagaattaaaaatctgatcgttaaagtcgtaatgccagccggtaacagtctcctccgactgccagggctgcttttccatgcgggaggctgcatagagaatcggcatcatctcctgtacccggtcgtttgacgcatacacacgcacgccgtagagaagcgggttgttgtttaccagacgctcgagggacacaatatcgctgttcttaaagctgtaccattcctccgccgaaaaagtctccccgtccttcgttcttttgagcatttccaaaagcggctcatcgctcaggaaaaactgtgtggacatgttgatggaattgatcttggttgcaacggcatctttgttgcgctccatggtgtactccatatatccggtattctccgatacgacgtttttctccatattgtaaaaaaggatgccggcaagaatgccgatgggaatcaccataaacagaataatcacaagggtaaactttacattcagtttctggctgacaaaccgttttttccaattcatgtaacactctccgtctctttactggatgccaagcttctctttggcgctgttcatatatgccgtcttcttctccatgacatccgtatagcccagctcatcccgcttctcaataaattcttcaaaaagggtgtcaaactcctcctccgatggtgccataagaagcgccggaagcgtctggctccagagctttgtaatcttgtcctcctccgatgcctccttggagccggagtcaaataccacatcatactgaccgttgtatacgacatattttcttccccattcctccagctgtgccgttgcaggcgatggttcctgtttccactgaagctgcatcacattgtcctgcagcatccagtaggcatcgtccgccccgtattccctgtcgtaagctgcgcggtccgtgtccagaatctgcttgatgttatcgcggagtaccggctttccgtcctttatatcgtaagtcacaccctcgacgcccagataggtgagaagctgcccgtgctcgctcatcagataatccagaaacgcaatcgcgcgctccgggtgtttgcagttcttggaaatcagcgtcaccgtccacccgttgatcgtggttgtcgggcgcagcggatcgtccccatttgcatttctcggaccttccaccgccatataaatgctgtccggatcattggcatataaaattttctgctgtgtcagcatatccgaatattgatacagcatgcagaagtagcggccctgcgccactttttcctccatctgtgtccgggtgtccacaaaaatatcattcgcaagataaccttcctctcccagctgtctgaatactttcagccagcgaaaatattccggatcggtatagcggtcatagtagacgccgtctttctcccacggaatggcaagaaaattcatcaggtatttgtcaaaggagacatttccctcgttgtcgaacacgtgcgcaccgatcgggatcagaggctccccgtctacttccggaaacatctccgctgccttctttaccgctgcgcaaaagccttccggtgttgtcatatccgggcttccgatcgcctcgtagatatccttgcgcaccagaaaggtctgattgctgcttaaatcctcgcactgctctacatcctgcggcgtgatggaggagttcgggtaggcgtaaatattgccgtcgtccgtggtataccagttcacggccaccgggtccgagacctcccagaaatacggatcatagctgtccgcaagctcattgagcgcatagaccatgccgttttctgtcatctcgctcacctgcggttcccaccatccgagcgtgattaaatccggcagcgagtcggacgcaatcagggcgttcagtttctcggattcatttccgagcggcgtgataaaatgaatatccacgcccgtctcctccgtgatcgtctgcgacaccaggttctcgccccacggcgtcgaaaaccaggagtagttgatataccagtccagcgtcaccggatcgtctgcgtacgtctgccatgccggaagatccccgtccggctgcacttgtccggctgcttccgtttccggcacatttccggaagcgccggtcataacattcccgcaggcaccgcacagcgccgctgttataagagaaaaaagcgtcacacacgcccattgttttttatatttgccacccattccaatcccccgtttttctccgtaaaatcaaagattttcctgtctctatcatataatattttccggcatatttccagcaggaaaagccgttttcccatctcccctgtactagcgtaaagcacgcaaagaagcactttccgtttccggaaagtgcctctttttaagaggagaactatgaaaataaagttttgaaacctgctggcagtttattctttgacgctgcccgccgaaatactgctgataatgtatttcgagcagaaacagaacacaatcaggatcggtatgacagagattgccaccgccagataaatagcgccctgatttctctgaatgtccgtcgatgcttttaacgtcgccatcatgaccggcaatgtaaacttctcatttttgtttaagataatcatcggaagcagataattgttccagtttccgataaatgccatgatcgccatcgtcgcaataccaggagacatgatcggaagcgcaatcctgtggaaggaatataattcgcttgcaccgtcgattctggctgcctccaccagtgccggcggcatcaccgataaaatgtactgtcttaagaaaaacaccgttccgggtgccgcaaccgccggcacaatcagcgggatataggaatttaccagttttaatttggtacataaattgtaaaaaccgatcaggctgagctgtcccggaatcatcataaacacaaggatcgccgtaaagatcagcttgttgccgcggaatcgatacattgccagtccatatgccgtcatcgccgagaaatacgccgtcagcagtgtggcaggaactgcaaccagtaagctgtttgccattccgcggaacagattaaagaaactaaatacggtctcccagttttctttcagatgcgtgctcggtatcagcgtaaagaaatgtgtaatctccacaccgtccctggtcgcgttgaccatcatcagaagaaacgggaacaggcacgccgccgcaagcaggacaagcagaatataaataacgctcttttttatcttatcacccgtcgtcataactaatcctccttgttgactaattttaactgcagcacagatacaatcagaatgattaagaacaatgcatatgcaatggcagatgcatatccggtctgtgttgtgcctgtcgagaaaccaaatttatacagatacattaccacggtctcaattgagttgtaggatgccgccgtcttctccgacataaggaacggcaggtcaaacatctgcagtcctccgatcaaggaagtgattgccacgtaaagcatgatcggctttaacagcggcagcgtgatttttccaaatgtcgtccagcgccctgccccgtcaatcgctgcggcttcaaagtaatctttgttgattccctgcacgcctgccatcagcataatgaaggagttgccaaaccacatccatgcactgatgactgcgatgacgcttcctgcggtgccggaatttccaagccagtctaccggcgccttgttcactccgaagaactgatagacggaatttaagatctggttaaacgtaccgtatctccagtctaacagtgtcttaaagagaaaagcgacagaggtggctgcgatcaggttcggcagataatacagtgcccgaaacaccggcagccccttaaatttatatttaatatcactgaacacaacggtcagcaaaaatgcgagtcctaactgtagtacgatattaacgccccagatcctgattgtattccagagcgctctccagaaaaacttatcggtaaatacgcgtgtataatttttcagaccgacaaaatggtacggcattcctgccagcttgctgtcggtaaagcttaaaacgagtgtgcggaataccgggtacacactgaaaatcaggaaaacgatcacaaagggagccacgaaaaagtagcctgcccggttatactttgtgaggtttgatgtcttttttttcggatttgtttttgccataggaaatcccctctatctcattttgtattccccctccggcaccgccacaacatcctttggggacattgtggctgccgtccgggaggataccaagttaccctgctcttatctgtttactgtgatatcaggatatgtagattcaatcgtgtcatagaaatcattcactgcctcttccttggtcatctgtcctgtcttgaccgcagagatcgcattgccccatgcatcaccgattgcctgatcgtaacgggttaccttggaggtatcaatctccttcgcctgctctaaccagaactggtacagtttctcaccgccgtagattgcattttcatcatctttgtgcttctcaagcgcggatttcagagaaacggtatcgccctgggagaaatcgatccaccagtctgcggtgtcttcatttaatgtacagaattttacaaactcccatgcggtatctttgcggttggactgggaggaaataccgatataggtaccaccgtcaaatccggaggaaggtcccttgcagacgccccacaaaccggaggtgtcgccgacattatctctcatggtaagtacgccccaggacggcagtccgaacgcgaagaccgtcgtggtgtccatgcccttggttgcctctgcaaactctgttgcatcccatacgttgacagaatcatccgcgtaattctggatatctgcggttaagatcggaacctctcccgccattgcctgataccacggcgtggaccactggttggcatatgcggtgagatccttctgatacagatccacacaaagatccatgtaatcaaatcttgcctggtctacatttaagacaccgtcaaccacccatgcggaatcaccggaaaatacgcccatctctgcgtctgaggagaaaatacggtatcccgcgtccttcaacttctgcgcggtatccagaatagtcgggtaatccttaaataatttgccgacctcatccggatcatccgttccgaatacttccttggcaatatctcttctgtaatagatacctgccggggtgatctgataggaaatggctctctggatgccctcggaatcctgtccgactttccatacataatcaacgatctgatctgcatagtcctgtgcgttgtacggtgcctgattcagatcctcaaaaaatcctgcgtcgtaaaaatcctccagcatcttcggctcgcctacgataatatccggttcgctctcgccgcccaaaagcgctgtctgcaccttggtcggatagtttgcaggctcaatgacaaccgtgtcaacggcaactccggtctgctcttcaaagcgctcaccaaagtcgatcaggtcatttgagagtgtccataccaccagcttatcatcgccggaagcggacgtgcctgcaccctccgtagattctgcggtacttcccccaccagaagctgcatctgtgcttgtttctcccgaatcgccgcatgcggtcattgataatgccataatgccaacgagcatgacggatactgcttttttccaattcataaaaatatcctccttttatttcaacatctctgttgttttgatacttgcattatagatgctttcatttcctcaaaaaatgatccaaattttaaaaaggtatcatttttttagtccacggcaacctccatttttctgacccttccggcgcggatatcctccgccagttttccggagactttctccccctcaacggtcgcctgactgccattttcatagaaaaacaccatatggcggatccggtaggttcccggcacataatccctgtgcccgccaaattcatagcacacggtcgtcttgctcataaacgcagcggaaagtctgccatcctccggaatcagatacgccggaatggccggtgcaagcgaaaagaccagttcctcctgctccgtccggaaaggatgtgcgccgaacatcatctctttccacatgctgataaattcgatcgttgatccgctgagtcttgccacgaatcctcttccgcggcaggacggattcggattcctgctgctggctataaacgaggaattttcgtaaatgcttcttccgtaaatctccgggttctggaacggtatcgcagccttcttgaaatccgcgaaaaattcttcatagagaccgctgcgcagaagttcaagaagatatttatattccatatgaagccagatggattcgttttcgagccagcccggggtaaatgcacgcgcacgcccaagttcaaaagaggaatccgcaagggaagcattcaccttgtacatggacagttccccgtcgtagagatcgctctctttgaccgcttcgtacagggcacgcttctcgccctgctccacaggcagcttcagatagcgcaccggtccctccagaaaatacggcatattttggggaacaaattttaacgggcggatgccgccgtcctttaacttttcatactccggcacctcgtaagtaaaatacgtcgggcagatctccccggagatccggcgcgcctttttgattccgcaggtaacaatctccaagaatccttccagaatcgccgcaagctgctccgtgtgatagaccatcttcttaccggatacgccctgataggtcttgtcgcggtaaatctccttcgcgtcattgatccggttccagaaggacaacagttcctcgtcccgcatgatattgtcgtgctccagccgcgtgatcagattcagttcatccaggaaacatcccagttcctctatgagtgcgacttctcccggatattgctttaaggcctctatggtgtaggagagcatgcgcgccagctcgtaggtctccgccatggaagaaccgaaaagtcccggcataccgtttagggcgtcataccatccgggctttccgccctccatctcgattcccattccgtaagcatccagcgtggcaaatttcacagcaccgagcagtatcaatttctccatcagcgtcatggtcagcacatccccgctgccgtattcggttctcaccagtttttcccccaagtccgcccgcctggacgcctcgtttaacgcccggtactgccttaagccattctccgtctccacatagcggcggaacctgcggttcacattgattctggacaaaaaggtggtatagacctcctcatagagcatttccttctcctgctccgggaacacggaaaggtaatccagaatcagatcgagattgtaggtccagtgatcgctccagtagccttccccgaacgatccgttcaccatctcctccgcaaaatcaatgacccggataaataacgtctcatcccaggtatcgccgaatacctccccgaacttccggcagagtgctccaggcgtaaacggctttgtcacgaagtcaatcagcgcgcttctttgctcctccttcacgtctgtcaacagcttctttgcccgctcctttgaaaggcggtaggtcagtttctcgacgccaagcggattgtacccgtccagctggatcagactgtagaattcctgtatattctttctgccgacgaacggtgcaaaaaaggtgtcgcagcggcggttctgattgacatcgcggaagttcccgtttccctgcgaatagaattccggcagcatggaaaagtaattgtaatcccgctccagatcaccgtgttttctggaatagacataaaagatcttattgttccccagctgcatcggataaccgccgcgcagcacattgtccatataagtgtacctgcagtaggcatcgaacgccgcggaagctgtcctggtgcagataccgtctgtcagcgcctctgcaagttcatcagcttctctttttttcgcctcaaaataggcggcatctttcttttccgcaaaatattcctttaaaagctgcttgttctccacctgtccgatcagttcatataaggtgacgcttccgcccggggcaagggtgcgcgtgatgccgtaaaagctgcacggcagcaggttctgcgtcatctgttcttccagaagaagttcctttaacgggcgttcttcaaaaccgaccggtcttttcagcgacagatcataggaaaaaaccaaagacggatccacgatcggttgcaaccgtctgccatccgcttcgcagcatgccgagaaattgccgccgtcgatcctgcgcaccgccgcggtgtcatccatgcttgcccgcacgcggtagtacggcagaccctcgtttaaatcctcgacctgcatccacgctttcgcggtctgccccatatttttcatgctgtccatggacacgccgtacggaatcaccgccggcatgccgtcaagcagttccagctcgatgggctccccggactgattggtgacactcaccacgcgcacaagcgcgccgacattttctccgggcagtgtatagtacaccacttttgtgtccattccacttgaccggttctgctcctcgattgcaagaccattcatgtgaatctgcatccgttgcgtgatgttctcatccgaaaacggttcaaaaaccgtaccgttcttctttaaaaatgtgcggaaccctgtggtctttacattctgatatgcctgatgcgccggataaaattccatgatcgcatgatctttattgtccacgccgaaactcaccacacactgtccgcgattcacatagtagcaccagatcgggattccccgtattcctgcaattcccggcagaaaactcgcaaatgtggattttttcccataatcattcattacaaacgtctcatttttccctgtcatctcattctcctttacaccagttccaccaaaatttcatgcgtgacatcaaaatccagctgctttaaccgctccctgtcgatgcagacactgcgcgtctctttctctcccccggaataatcccacaattccccgtcaatccggatcgttcccgggcggtaagcgccgtactccttgtgctctttgttctcgtagaccagatgcagcgactgtcccgcaaacgaaaagaaaagctccgctctttcatccagatcaaactgttgccgctccagcttcggttccaacatcagattgccggcacatcccttcgcgccgaacatttccgtaatcacggtaagcatgtaccagcttgccgcccccgtcagataatggtacattccctttccgcggctgttaaaatactccgggattcccggataaatccggctggtttcaaaatggacagactgacggtaaagcgcatccaatgcccggtgcccttcctttacaaatccccgcttatagagggcgtttgcaaacatcaccgccatgtgtgaaaagaccgcaccgttttccttttccccgtaagcgaacccgaacattcttcccagatccattttcacttcaccgaaatccgtatttaaccggtaaccgcccatcgcgtcgcagtacagatatttgtctgcgctgcggacaatctctgccacctgttcatccgtcgcggtctgtgccataacggcaaacacctgactggtcagcatcatgcgcacgccctgcgcaaagacaccctccacgcacctgccatgattgtcatagtatccgttaaaccagccgtttccctcctcatcggtcacccactctgtggcacggatatgtccggtcagaaaggctgctttcttctgcaggctgcggacaagctctgtaatcgaaacctctgtcttctgcccgcttacttcatggatgcatgcatcggtatagcgcgttaagagttcctgctttttttgaaccgatgcatacagggtgtcgtcatccgcaagcagcacgaaaagatcccgatttaacggcacagactccttcccggttttctctgcgtagagtgcaagcagctccgcgagttcccggagattgcctgcataggcgttggtaaatgcaacgctctccccgcgctcgcccgccatatccagcgcatcgttccagtccgcgccgcgaaggcggatatgtccgtgttcgcccacctcgtagaaagccgtcagattctgcagcagaagatgctccagcacgcttccgcggtagacatttcccgcggcatccctctgccagcagccgtcctgcgccttccatgccgcatccttctttgtcccgcgccctgcctgctgatccttaaaatatgggatctcttcctccagaaccgcaagatcgccggtctggtcgatatagagctttgtcgtcacaaacggccagaccccgtgatccatccacacgcgcgtaatctgattgcggtcggcgataaaggttccctccttgcttccgataatggtcgcattggttccgtcgatgcggacaccctgaaaattattgagaagcatctcgcgcacaccgtccggattcatcaaaagaagtgccagacagtcctgccagagatctctccagcctcttcctccctttccgtaatcatggtgcggcaaaaaggaacagccatagatccggcgcaggatcggctgaaagctgacccactgcatatagcggtcaaactggcggtctttcgtgtggtaggatacatttactttctgttcccagtatgttttcatgcgctcatacgccgccttcgtctgcgccgccgtgcggtacgctgccgtcatgcttaaaatcgtctccccggcatattccgtctttcgcaccgccccgatcatgatcgtgtatcctgcggtctcgcccggtgcaagaatcctctccttaaaatggagtccgccgaccgcctcacatccggcatatgcactgcccgccggcacaccggcaagatttttgacaaccgcctttggccgctcaaaattacctccctcgccgataaaatcctgcacggtcgggtaaaaatcttccggtgcctcccccgtctggtcgtatccgcacacaaagtaggtcatctcgttcgggcggtgcccccgctcgtcaaaagacatcgtcggcgtcacaagcacaccgttctccaccgtgcggatgcggtgcagcagcgatgtcacatgccggtgatccctcagattgtccgcgctcctgccatagaccggtatggctgcggtcggcgtgaatcgtacctgcatgttgcctgtattggtaatctccacatacatgatctccatcggatcgtccagcggaacaaacgacgtgatctgtgccgaaagctgatacttcctggaggttctcgtcacggtctgccacataaaaccggctgtcacttcgttttcatccgcaagatccgtaaatttttttgcgatttcttccgccgaattgcccgtggcggaccagcttccgtgcgttccgatatggcaccagaaatttctggcattccgattattatgaagattctccacgctcaccggctccagcagaaacgtattctgatccagcttgcagtccccgccaagtgtcggcgtcaccgcgcttttgataccacactcccctgcgaccgggaaatacagatcactgtaatctgccgcccccggcagagaaaaaactcccttatcactgataaattgatatgtattctgcatcctgcaagtttcctttcatttttttattattctaaggaaaaaaacaggcacaaaaaaagataccttttttttgaaaggtatcttttttttagaatcccagaccgtccggaaaaatctcatgcagcggtctttttatttttttgcgggtcacctcgaccagaccgagtgcggtcatatcgataagctgcgccggaaccggatctttttgcagtgccgcccggaatgtcttaagcagttcctcttccgcggattttgatgtcagatttataaaatccaccagaaccattcccgagagattccgcagccgcagttgtctggcaatctcctctgccgcttccttgttcacgcgcagaaagttctcctgcatctccttttttgccacattctttccggtgttgacatccaccaccgtcagagcctccgtcggctgaatgaccagataggcaccggattttaaccatacgcgctcactcaatgcatttttcagctccgaccggacactgtagagtgctccaagggagagcgccggatccttgtaataacggatccggattccatccgccgtcattacatcgtccaccggcacgggcacgcttcctcccgtcgtaagcgcctgcttatggatccggcaggcactgcagatatcctcgaacattccgcggtcatctgtcacaatctcttccagatcgtccttccgcaggtctctgatatggcgcagccatcccgcttcctccctgtatacaagcgtgtaacagttcttgtgtgccgccgcctccgccatcgtctcatagcgctccgaaagcacttccagttcaagcagaaccgtctcatcggaagcctctgcggcattggtgcggagaatcacgccgtactcccctgccgtctgctctacaagcttcaccagacgctctctggcctccccctttacctttgatgagacgctcttcttccggtttccggaagttaagacggcataggttcccgcgatcgtcaggtttgtcgtcaccgcgggatcttttgtcttaagcgcctcgcgcgagacctgtaccagaagttcatcgcccgccgcaagcgcctttgtctgcgacagctttctggtaaaaacgggattcttcacatcggacagcggcagatagcaccgtatatccggcgctatcttgacaaacgcggcatttagattggtgacaatgttctcgacttttccgacatagatattgccgagcagtgatgtctcccccgccgcctccggcaatacctcaatcatatgttttttctcatcataaagggcagaaatcagatattcctgcccttttatcttctctcgcgttatcatgtaacggttcattcgattacttctcccatcgcgcctaaggacacaaaatcatccccgtcggacgcatagacatccttcctgtgaatctgaatcgcattgggatcataggtaagtcccatgtgtaaaaacagcgcctcaagcaccagctccggcttcagattatccgtacttccggtggaaagcttcagatagaaggacggcacgccgccgcggtccgtcacctgaaagccgtagatgagcggtttgatatccagcacgcgctcgctctttttcgtctgcttggtgatgagaacctcatccggtttctcaaagaaatcgcggataccgtcagcaaacgccgaaacagaaaccggtgccgcatacccttccttaaaatacagatcataatctgcggcggcaacgatcgacattgccgtctttgcctgatccggaagtttcacataaccggtgcactccacgccctccaccatgacgccgtttaacgcccggagggattcctccgtggatgcactcgtgtgcacttcaatgtccatatactcgccgtcgctcgtaatgcccacgccgagcggcgcagcaaacgacatgatctggtgcggggaaaatccctccgaatagcagatgtcaatgtgtgctctgcgcattgccttctggaagtaccgcatcacatcgagatgtccgataaacttcatcacaccgtacttgcggaaacggattctaattttcatagcagacacctcctccgaacttcttcacaccgcagcccgaacagcgcatccggcagttcggcgtcacggtctctttcatggcattgttccactcacgctttaaaaattccttggtcacgccggtatcgataaaatcccatgggaaaatctcgtccatggaacgctcgcgcatcgtgtaaaaatcgggatcaatgccgcactccgcaaaggcgtccagccatctctgatagtcaaaatattcggaccatgcatcaaaaatgccacccttttcataaacctttaagatagcctgtccgattttccggtcgccgcgcgccaatacgccctctaagaccgtcacatccgcctcatgccagttgtatttaatgctctttttgtttaactgttccttgaccgtgtcgttgaccacttttgcacgtccgatgtaatcctccggcgggtacattcttgcccactggaacggtgtaaacggcttcgggacgaaaaaggaggtactgatcgtgatctggcatctgccgttccgcttctccttgggaacggtgtcataatagcgtgccgccgtctcattggcaagctccgcgatcgcccgcatatccgcctctgtctcggtcggaagtcccagcataaagtagaacttgaccttattccagccgccctcaaacgccatctgggcgccgtttaagatgacctcctccgtcagtcccttgttgatgacgtcgcgcaggcgctgtgatcccgcctccggtgcgaatgtcaggctgctctttttgatgtcctgcaccttgctcatgacatccagtgaaaacgcatcgatgcggagcgacggaagcgaaatattcaccctgcgctccctgcactcgtcgatcaggaaattgacaagttcctccagagagctgtagtccgatgaacttaaggagctgagtgagatctcctcatacccggtcgcctcaatcatctgtgtggcaagcgcctttaggcgctcaatatttttctcgcgcaccggacggtacaccattcccgcctggcagaaacggcagccgcggatacagccgcgctgaatctcaagcacaacgcgatcctgcgtggctttgataaacggtacgaccggcttttccggatagaccgcatccgtcatatccatcacgagctgcttggtcacagtcgccgggatttcctcatccaccggtgtaaacgacgcgatcgttccgtcttctttatattccacctgatacagggaaggcacatagattcccggaatctttgccgcctcatgcaaaaactccctgcggcttctgcccgcccgcttcatctcctgatagagatctaacatgcggtcatatacgacctccccttctcccatataaaacagatcgaaaaagtctgcaattggttccggattgtaggtgcagggaccgccgccgatcacgatcggaacggtatcgtcacggtctgcggcaagcagcggaatctggcttaagtcaagaatctggagaatattggtataacacatctcatactggatggtaattccaagaaaatccatattcttcaccggctcctgtgattccaggcaaaacagcgggatgttctcctccttcatgatcttgtgcagatccggccacggggaatacacgcgctcacaccacacatcgtctctcttattaaacatatcatagagaatctggatgcccagatgggacataccgatctcatatacatccggaaagcacatggcaaaacgaatcgatacctcgtctttgtttttacagacgctgttcaactcgtttccaatgtagcgcgccggcttatcaatcttcatcagtatctcatcggataacgctaactttgtcatttcttttatcctttcattctgtatgcagaagttctgcaagcactgcgtcgcactcctgcaaaattgtatcataccgattatcttcgatcatgtcaatcattttcgccggagtgacgccgcaaaccgtatttccactgtcatcccatgcaaaaaagaacaaaaacagcagcagtgccacaagaaagcggagctgtccccccgcgcgccctctctgtggctcctctctgtcaaaaggctctcccgcatccgctaccgtctcaaaggaactgcggacctgtgagacatacgctctccgccgttctacatagtctgtcatactgcacctctcctatcccgcctgtgctctaggatactatatgagatttttgggaaaaacatgtgcgcagaacatcgatcagttttgaaaccgcaaacgtcaaaaaacggatgatggtctgatccaaaatgacggctcccacaaatgacagtgcaaacgtgagaagtacggcaagcagacagcctcccacgatgccgccggacaggacattgacgtgaagcacctgcttgacggcatagtggagcacgccccagtgaatcagcagaatcgaataactgtacttcccgatgacgcgcacaaaggggctctctttgctgccgcagggcaccagccgctttatgagcacaaacacggcggcggcataaaacatcatcgtaggcgcattgttgtaaatatagtcgtcataccagccatggaacagaatcacatagcaggtgatcagatatgacacaagacccgccgcaaggaaaaaattctctgcccgcttccccgcgcggttcgcgagataatagccaagcagaaacgcccccgcatacgaattcacaataccggagagtaccgcaggcggcgtaacgccaaacagtggcacataggtgacatacgcattcagaaggaagatcacaagcatcacgccgttcatgaccggatcgggaatgttctgcaccagataccgcaaaaacggggtgagcacatacagccagataatgacatagaccagccacagatgcggcgcttccaccggcggtccgatgaagaaccgctgcagcatcagtccccactgcgacggagcgagccgtccgattccctctttggcacagacatacagattgtaatagaccacgagtgggatgaagacacggataaaacggcgcgcaaaaaaatccctgcaccgctctccttttaccggcagcagcaatgcgccgctgatcatgacaaagaacaggttgcaggacaaaaacgtataattaaagacttccaatacgcgaaaaagcagcgtccccggcgctgctgtcgtcttcgcgagcgcgacggtgtggacacagatcacaaacaccgtcgcaatcacgcgcagaacatccatataaacctttcgcggcggctttaccgctgggaaagttcctgtgtgatatcctcccatgtgactcctctttctgccataagcaccatcatgtgatacaggaaatccgagatctcgtattttacctcttccggatccggattctttgccgcaatcacaatctcggtcgcctcctcgccgactttctttaagatcttatcgattcccttgtcaaacaggtaattcgtgtaagatccctccttcgggtgtgccttgcggtcgagaataatctcatagacatcctcgagtaccttaagcggattcttctccacatattccttcttgacaatctcgttgaaaaagcaggtcggattgccggtatggcacgctgctcccacctgggataccttcgcgaggattgtgtcataatcgcagtctgccgtcaaagacttcacatactggatgtggccggaggtcatgcctttcgtccagagttcctgacggctccggctgaaataggtcatcttaccgatattgattgtggtataaaaagcttcctcgttcatgtaggcaagcattaacacctcatctgtacggtaatcctgcacgatcacgggaaccatgccttctgaattctttttcagatcatcccactttaacgccgggtcaaaattgtccatcttgatgcccgcggaagaaagctgtgacttgatctccatgatgttggtattcggatcgtttaagaaaccgccggcaattccgcgcgtgttgctccgctttaacacctcaatgatcttctcgtaatcgcaggtctcaaaatagaccacatacggaacatccgtaatattctcaattgcatccagaacaccggtgtttaacaccagaagttcatggaaattctcattcatcttcgcctgatgtttgaacacgaagtccacattctccaccgacacgaggatccggtcttttccgaaacgcttgctcgcctcctcggcaagctcgatgctgttcgccttggcgccgttgacaatgacctgaaggcatccggcatagataaactttttgatgtcctcgaggcggttgatgttgccgcccgcgcaggtcttgatctccacgttacggttgatgttcttgatcgtgtgaatattcttctcatgctcctcatcatcgtcagagagatcaaaaatgataatcttgtcaattccgttgtcattgtaaagctttgccagctcgatgacgtccgccagcggggtgtgatcctcaatcccccgtaccgcctgtccgttctttaagtaaatcgttgcaacgatatttttctgttccataaaaatataatacctttctataaactgcccttcgtagacaaaatatccgtaatccgcggatcataagatgtcgcctcgtcgagggctcgcgcaaatgccttaaacatcgcctcaatcatgtgatggttattgcccggcgtcagcaccttgatgtgcagattcatccctgccgtgtaggagatcgcatagaagaactccttcaccatctccgtgtccatgtatccgactctctctacggtaaaattaccgtcgaaggacagatacggccgtccggagagatctaccgcgcataaaacgagtgtctcgtccatcggcagaatacagcttccgtaacgcttgatgccctttttgtccccgaccgcctttttgatcgcattgccgagcacaattccggtatcttcgatcgtgtgatgacaatccacgatcagatcgccctccgccttgaccgacagatcgaaaaaaccgtgtctggcaaagccctcgagcatgtgatcgaaaaagccgatcccggtatcgatctcgcttactccgctcccgtccagttccagactgagcgtgatgtctgtctccttggtctttcgcacataatctgctgttctgctcatactgactcccgttccttcccaacacttcaacttttattatattacggtttccacgaaaaaggaattacttttgttcagaattttcctcaaaccggacacggattgaattggcgtgtgccgtgagtttttcgcactccgcgaactggatgatgtccttgtatacattctcaagcgcctccctggaataggaaatgatgctggatttcttgataaaatcatccacgccaagcgccgagaagaacttcgccgtaccgttggtcggaagcacatgattcggtcccgcaaagtagtcgccgagcggctcggaggaatattcgccgataaagattgctccggcgttgcggatcttcgtcatcacctcaaacggattcttcgtcacaagttccaggtgctcggacgcaatctcattgaccgttgcaatcgcatcgtccagactgtcggcaaccagaatgtatccgtaattctccagcgattttgtgatgatctcctttctcgacagcttctccacaaagcggtcgatctcagccgccacctgcccggcaagcgtgcggcttgtggtaatcagaatagcggaagccatctcgtcatgctccgcctgcgacagcaggtccgccgccacataacgcggattcgctgtctcgtccgcaaggacaaggatctcgctcggccccgcgatggagtcgatgctgacataaccgaacacagccttttttgcaagtgccacatagatatttcctgggcctacaatcttgtccaccttcgggatgctctcggttccgaacgccatcgcagcgatcgcctgcgcgccgcccaccttatagatggcgtccacgcccgcctcctttgccgccacgagtgtggacggatagactttcccgtctgctcccggcggtgtcgtcataatgatctgctccacacccgccacttttgccggaatgacattcatgagcaccgacgacgggtagacggccttgccgcccggcacatacacgccgactctcgcaagcggagtcaccttctgtcctaagataatgccggattcctgtgaatcaaaccaggaattctggcgctgtctgctgtgatagtctcggatattgacaagtgccttgcggatcacggagaggagctttggatctaccttctcgtaggcttccctgatctcctcctccgtgacaaggatatttccggcatcaatgtcggcaccgtcaaactttttcgtgtaggaaaaaacagccgcgtcgcggttggcgcgcacctcctcgatgatggcgttcacacgcccctcgtactccccgtaggagttcgggctgcgctttaacagattctccagtatattctgctgtgtctctttggttaacgttaagattctcatgccagatccttcctttctatctctctctttaaatccgcgatcagcttcgtgatccgttcattttccatcttcatgctgacctggttgaccaccatccgtgcagacagcggacatacttcctccagaaccaccagaccgttctcgcgcagagtcgagccggtctccacaatatcgcagatgacttccgagagcccgacgatcggcgccagctcgatggaaccgttcagcttgatgatctccaccgtctgatgctttttattgtaaaaatagtccttggcgatgtgcggatacttggttgcaacacggatcagttcatggtgcttcagcaactcttccgcatccttcggtccgcagatgcacatccggcattttccaaacccgagatccaagacttcgtagatattgcgtccctcctccagtatggtatccttcccgacaataccgatgtccgcggcgccgtattctacataagtgggcacatccggtcccttggcaaggaaaaaacgaagctttaactcctcattcacgaaaatcagctttctcgtgtccttatccttcatctcctcacaggtaatgccgatcttctcaaacagttccagtgtcttttttgcaagtctgcctttgccgagcgcaaaagtcagatatctcatatcctccatattaaaacgtctctcccttctctgccttctacgcgaaaaactgcacgtttgtcatccggctgcgagctgcataatcctcgtaatctttcctttgcttcgtctcatcccacaacatcagctccacacagcgtccgactgcacgcgctgtcgccgctgcggtaatcgccttctgccgtttggcagatttatagaccatcagctccacacagcgttccaccggaacatcaattttctgtctctgcagtgcagccatcagctggtcaatcacaaacgcaaagccgatggatgctgaatcttttccaaaacaggtgaggagccggtcgtatctgcctccctttacaatcgcctctccgcttccgaacgtatatcccgcaaatatgataccggtgtaatactggtagttgctgatcgttccaagttcaaacgaaacataacgggaaacctcatagacttccagtattttatgaagttcctccagatccccgatcgcctttaagatcctgggataggatgctgcacattcccttgcggcagaaagttcatccgaacccgtgtagagattcccgagcatgccaaagagattctttaagttctcctcgaggtttaaagtctccacgaactcctccacaccgaaaaagttcttgttggaaatgagttcgcgcagttcctcctcctgctcctccaaaagccctgctgcctccatcagtccccggaagaaatccgcatgtccgatgctaagctggaactccttaagccccgccgccttcaggcaggaaatcaccatggagatcatctccgcatccgcatccactgatggatctcccaaaagctccgcgccaagctgtgtacattccttcagtcgtccctgatagctgctgttattgatgaaagtattccccatgtagcacagccggatcggaagttcttcctcgccaaaatactttgcggcacagcgtgcaatcgacggcgtgatatccggtcttaacaccaacgtgttgccttcccggtcaaaaaacttgtagagatccttcgacggcgtggtgccgatctcccgtccgaatatatcaaaaaactcaaatgtcggcgtctgaatcggatgataaccgtgcagacgtaatatatgatatagctggtcctgaagaagcattttcttctcacactcatcattataaatatcccgcacaccttccggcgtatgcaataactgtcttttcatgatcgccctcatttccctgatacttttatactttaccttgctactatggtagcatgatagcaagtgaaactctgtttattataggagatcttagaataattgtcaatccctgcgcagcaaatccttctgcagtgcatccagatacggaaccaaaacgccacgctgccgcggcaggaaatactccgggtccagttcctcatagcggaaactctttcttccgccctcctttgcgcgcttccagaactctaagagcatatccaggcgcagatagtagaactcatcccgcttcgtaaaactgagcaggaaaaaagatacccctccctgtttttcaaagttctccatgaacgcaacctgatgttcatgaatattggcaagtggaaaggtatccgtattacattcttttgcatcaaaacagaccggtattccctgtacggcaccgatatagtccaccgtgctcttctggtcaaaatacgccagcgtgatatgtctggtctgtttgtcgatattgatcggcgtgatcggtgtgggaatcttctgaatcagcgcaagaccgttctcctgataaatctcattggtacggttgataaactcttccagcgttgatccacgcagtcctcttgaattccaagttgccatattgcctccagatactctcttgacacaccggcagttagctgccgtcatgcatctttcatccttttcttttctctattatatagaattctcagtaggtacacaataaaaatatccctttgtcaaacctctccaattatgatatacttgaacccagagaggggttttacccgaagatcctagaatgaaggttagcaatgggagggatgccagatggtcatgaatgagtcaaacgagaattacctggaaacgattctggtcttaaatcatagattgggcaacgtgcgctctgtcgacatcgccaatgagatgaactttaagaagccaagcgtcagcgtggcaatgaagaatcttcgtgagaacggttatattaccgtcagcccggaaggatacatccatctgacggaaagcggacttgaagtcgcggaaaaaatttatgagcgccacacaatcttatccaactggctgacgatgcttggggttgatccgcgggttgccgcagaggatgcgtgcaagatcgagcacgatgtcagtgcggaaagctttgaagcgatcaagcgccacatcaattccagtgcaggaaagatttgaggcggtcagatgccacatccatttccgtacaggaaagatctgaggcggtcagacgccacatccatttccgtacaggaaagatttcatcgaaaacgacaaaaatggaagttcagcttaaggttgaacttccattttttgtgctgcaattctttctgccacaacctgtctaccggttcttacaccactcttccacgcgcgcgaactctgcgccgcagggcgcgatcacttctctcccgtccgcaaagacaatgcggtatgcgtgaagcatctgtgattttaccttacactgtctgcggaactgttcgtttgtgccggcgtcgccgtactttacatccccgatgatcggatgtccgatggacgccaaatgcgcccggatctgatgggaacgtccggtgatcagatgaacctccagcccggtgtaaccgccgcccgtccagatgggccggtacgctgtctcaatcggcgcggcatccgcacttttgggttttaccgtactgacggtaactttattctcacgttcatccttaacgagccaccccttcaagtaatcttctctaaggacttccccttttaccacacaccggtaatacttctggatcgtccgctcctttaatgccttagacatctcctgaagtccctttaaagtctttcccgcaatcagaataccggaagtattccggtccaggcggttgcagactgacggacggaaggtgcgcatctcctcctcggtcagcgctccctccctaagcagatagcttaagatatattcattggcggaaacatcctcgggtctcgccttctgggagagcatgccggacggcttgtttatgataagaatatccgcatcctcataaaggactttaagctgccttaaagtcttttctgaaccactgaaagcttctggcatcaccgtttttgactttgcccggaacttctcgtaggtctcgtccgagagaaacaacttcacctcgtccccgcaggagagcttctccgtgccgtccgcctttttgccgtttaaggtaatgtttttcttgcgcagcatcttgtagacaaaactgccgggagcctctgccagaagcttttttaaatacttgtcaaaacgctgtcccgcgtcgttctcgccgatgtgcaattcctgcatagtctctctccattcgcccgcttactttttccccgcacctgcttttttatgatgaacattgcggattgtctttttcgtatttttcttctcggaagcatttgctcttccgcggttattcccgccgcctgccgtgcggcggttcttgtcacctccagcgtagcggtctttggcgtttgttgtgccgtagccgatgccccgcggccgtaccagacagtgtttgtcaaagccgatcagatccgtccgtcccgctttggttaacgcctccacaacaagatcgtaattcttcgggttccggtactggatgagcgcgcgctgcatggctttctcgtgggggtttaccgccacatagaccggctgcatcgtgcgtgggtcaagtcccgtatagtacatgcaggtggatatggtcgacggggtcggataaaaatcctgtacctgctccggcatatagccgagatctcttaagaattcggcgagttccaccgcctccttcaacgtcgatcccggatgggatgacatcagatacggcaccagatactgctttttcccgagcttctcattcatatcctgataggccttcacaaaccgcttgtacacctccacgcgcggtttgcccatcttctctaagaccgcatcggaaatatgctccggcgccacctttagctgaccgctgacgtggtgttcacagagttctctgaggaaggtgcggtcctcatcgtagatcagataatcgaaacggatacccgaacggatgaacacctttttcacattcggcagttcccgtagctttcttaagagcttcaggtaatccttatgatccacctttaagttcttgcacggtgtcggaaacaggcactgcttgttgggacatacgccctttgtcatctgcttgtcacatgcaggcgcgcggaaattggccgtcggcccgccgacgtcatggatgtatcccttaaagtccggttcccagacgatcttctccgcctccgccagaatggactcgtggctgcgcacctgaataatccgtccctgatggaacgtaagcgcacagaaactgcatcctccgtagcagccgcggttgctgaccagagaaaaacgcacttcctcgattgcaggaaccccgccctgcgcttcgtaactcggatgatacgtgcgctgatacggcagcgcatagacctgatccatctcgctttgtgtcagcggcttcgccggcggattctgcacgacaaaaagctttccgtcgtacgtttcaaacagacgtttggctacaaacggatcggtattgcagtactgggtataaaagctgcgcgcatatgccgccttgtccgccagcacctcctcataatgcggaagctctatggcatcatagatgtcctcacgctttctggtcttatagaccgtgccgtcgataaatgtgatatcgctgaccgccagtccgctgtttaaggcatccgcaatctccacaatgctgtgttcccccataccgtaggagatcagatccgccccggaatccagaagaatggaccgcttcatcttgttcgaccagtaatcataatgcgccagtctgcgcaggctggcctcaatgccgccgataatgatcggcgtgtgcttgtaggtctgccggagcagattacaatagacaatggtcgcgtaatccggccgttttcccatcacgccgcccggcgtaaacgcatccgtcgcgcgccttttcttggacaccgaatagtgattcaccatcgaatccatattgcccgcagacactaaaaacccgagccgcggctccccgaagatacagacagactccttatctctccagtccggctgcgagataattccgaccgaatagccgtgtgcttccagaagtcttgagataatggcgtgaccgaacgaaggatgatccacgtaggcatccccgatcacatagacaaagtcaaactgtttgattccgcgctcttccatctccgcacggctgactggccaaaatccgttgttcattctaatcctcatttctcttcggctgctcattctttaacgcagcaagctcttccgcggtcagtttccggtacgctcccggtgcaagatcctccggcagcaccaatggtcccatggaaatccgcttcaaatacagtacctttttcccgaccgcctcaaacatccgctttacctgatggaactttccctccgtgatggtaagcgtaatctctgacacatccgctttacagcccagaattaccagatctgccggtctgaccggcttctcctccccgatgtcaaccccgtttttaaaaaggttgacatcggtctcatccaccacgccctgcacccgggcgtaatatgtttttgccacatggcgggacggcgacagcagcgcgtgtgccagcgcaccgtcgttcgtgatcaaaagcagtccctcggtgtcgagatccagccttcccaccgggaacagatctcctcttgcggtgtcgctcagataatccatcaccgtgcggtgcatattgtcctgtgtcgccgacacacagccggcgggcttgtgaaacagataatactcaaaagcggtatagagcaggcgctccccgcgcaggcatacctcatcgcccgtctcatcaaccttttgttccggcttttttgcaaccgctccgttcacggtgaccagaccggctttgatctgtttttttacctcgcttctggttcctgcgcccagttctgtcagatatttatccagacgaagtgccatttttctccctcactgtctctttgtctcaccgaatgtgtactttccctgctgttcccagagatataacaccatcggatacgggtttacggaaagttcctgcccgttctcatcgttgatatagattccaaagtgcagatgcaccggaaagttgccggtggttcccggaatatcgctgtaaccggtatcccccatatagcccagatgggtgcctgcaaggactgtctccccaacttcaaactccttcgcatactccgccagatgcgcataataaaaataggctccggacggactgcggatgccgatgcggtacccgccgaggcgaagccatcccacattttccacgactccgtcggatacgctgtatatgggatagatgcctcgctcgttcaccgaagccataatatcacagccttcatgtccccgctcaccgccaaagttcctgctctgcatccagctgtctgcaaagctcactcccgcattcccgtcggaggccaccgtcccgaccggaaaacgttccagatcgtcccacacggcagaaagatagccgcagatccgcgcatatgcctgcggctgataccgttttgcatacagagcctctacggccagctgcccgggatcggtgacgcttccatcctccgcaaaatagacggcaagcagttctttttccgacattcctttttcttctgcctcctcctgcatccgggcaagcagttccccgctcacccggtgttcccggaaactgtaaagcgccgtctcataggaaaaacagtttatctgtctggttctctccagaatccatgcgtttaaaagaacgttccataggatcatggtaaacagtaacagcagcatacggacatgtctgaaattcatatcattccttttttatttacatttttttaaaaatgccaccagaagcttccatactttctcggtcgaggagatggacagacgctctttcggcgtatgaatatcgtaattgttcggtccgaacgatacacagtcaagctccttgatctttccggaaaggataccacactccagtccggcatgaattgcctcaaatactggctcctcctggaacagctcctcatatacggcactgatggtatcgcggatctcggacttcgcctgatactcccatgcaggataatcaccgcttacggcaatctctccgcctaagaactctgcgatatgctccagacggtcacgcagatcttccttgcgggaagacacactgcttcgcacggaggatgtcgcaagaagcgcctgatcctctaattttaagatgccaagatttaatgaggtctccaccagccccggcatcaccgtgctcatatgctgtacgccgttcggcacatggcgcaggtaaaaaatcactctcgccatcgccgtataggaaagaatcgatgcctcccccttctctccgaaagcacagtcaatcgttattcccgcatccgataccgcatactcctttttaagctccgccgtaagttccttaatataggtggtaagctcctcttttttctcctccggaatcagcagacctgccgtacattcacgcggaatggcattgtcctttaaaccgccctctaaggtcacaacgcccagttccatccggtcagagacgtattttaacacacgtcccatgaccatattggcattcgcatgctctttgtcaatctcacttccggaatgtccgccgcaaagtcctgtcaccgtcagcgtcaccgcaagtccgttctgggacatacggtcaaccggaatcgtagtctccaccgtcatgccgcctgcacagctggtcaggaaatgaccctccacatcggaatcaatatttaaaagcttgtgtccctttaacatggacagatcaatcgcctcggcaccgagcattccgatctcctcgtccaccgtgatcacaacctcaaggcgcggatgcgcaatctccggcgaatccataatggcaagcgcataggcaacagcaatgccgtcatcgccgcccagcgtggttcctctcgcctttaagaaatctccgtccacgtagagatccagaccgtccttctcaaaatcgatcgcacagccgctttccttttcacataccatatccatatgtccctgcagaatgatggtatctgcctgctcatagccggctgtcgcctcctgcacgatcaccacgttgttggactcatcctgataccaggtcagatcatgctttttagcaaacgcaaccagataatcactgatggcctttgtgttcctcgaaccgtgcggaatcgcacagatctcctcaaaataatcaaacactttctccgactgtaactgtaatgcctgtatttcttttaaactgctcatagaatcctcctgttcttcatacattctagtatgaaaaagaaattgatattcctttgtctgctattatttatttcctatatcttaaccgccccgaaagatgccgtaaacgccgcatccgtaggactcgttctatggtacacgcgcgttcttccgacgctgctcccctttgtcattctgtccaatatcctgatggactcaaattacctgcaatatctgaacaaaatcaccgcaccgcttgtatcccggctcattccggtcagcgacaacggggcttttgttctgttaagcggctttctgttcggctttccgatcgggagcaaaaactgcgccgccctgcttgcaagcggaaaaatcacacgccgggaagccgatgttttatttatcattaccaacaacatcagtccggtctttgtcacaagcttcatcctctacacccagttaaagctgtcccatctgtcggcagttaccctgctgatcctgtattttccggcgcttttgctgggcagtatcctgctctctacagacgcacgccgcacaaaagaccgcaccgcgttccacgcgcaaaaacagccggcatctggatctcaaatgaattttaaaatcatagataccggcatcatggatggttttgaaacactgaccagacttggtgggtatattatgctgttttccatgatcgcctctctcctgcagaagcttcccgttccccatatcctcacactgatccttacaggaatggtcgaaatcacaaacgggattgccatgcttccggactcgggtctgccgcagtccgttcagtatgtgctggccgtggtctataccgccttcggcggactgtccggtatcgcccagacaagttccatgatccgtgacacaccactctccataaaacactactgcatcgcaaagctgcttcttgctgcctgctgcggactgctcgcctgcctcgtctcacagatctttcatctgtgagacagtgcgttcggtcagcccagcatatccgaagagatctccaccttcggaccgtctgcctgggatgcctgcgcatccgtcgtcttggtctccggctcctcggcagtcggattaagctcggcacggttcgccgtcactacatccaggaatccctgcagggaacttacataagcatcatggcgcgccttcgccgcatccatggaatgtgagatcgtgttctccagattccgcagaatgtcatccgtatactgcatggcacccatacggatattgttggcgtcattcgttgcattatcgagaatctcctgtgcctgcttggttgcaatcatgaccacttcattcgcctgcgcatatgcctgctgcatgatctgatgctcgctgaccagctcgtccgtcttgacctgcgcctgtgcgatgatcgcatctgcctttgcctgggcatctgccagaattgcttccttattgcttatgatcttctgatagcgtttgatctcctccggtgtcttgatgcggagttcgttgagcagctcctccatctcttcgcggtttacgataattttagaagaggaaaatgtctgcggcttgcagccatcgatatactcctcgatttcttctataatctgttcaattctacttgccataagcctctccttattttgagatgtgatatttctcatagatcctgtctatgaatctcgccggaacgaacttggagatgtcgcctccgtaggatgcgaactccttcacaatggtggaactcagataggaatactgcaggctcgtcgtgagaaaaatcgtctccacttccggattctccacatgattcgtctgtgcaatctgaagctcgtattcaaaatccgtcacagcccgaagcccacgcactatgatcgtcgcgttgatctccttcatatagtctaccaaaagaccgtcaaaagatgcaaccgtgacattcggcatggattccgtcatctcttttatcatactaacacgttcgtcaagagaaaacaacgaattttttgcgctgttattcagtacgccgatcaccagttcatccacgatttttgcggatctcttaatcatatccagatgtcccagtgtaagcggatcaaaacttccgggatatattgccctcttcataggtttcttctccttttcgcatgctccggctattttctgcggataaatgcgtgctcatttgtcttgtacatcttgaggcgtgaaagtgtcattccatactcatccagatagctgaaatccgtatctaacgcagcctctacgatcagaaccgtgtcctcttttaaaagggaagatcctgcaagataccgtaaaacctcctgctccattcccttgcggtaaggcgggtccatgaaaatcaggtcaaactgatatttgccctccatggcgcgcagcgcgctcaacacttccgtcggatacagctttgtctgatgttcaaacttcgtaaaccggatattctcctcgatgcaggctgccggctttttgccattgtcgacaaacaccgcatagcgcgcgcctctgctgactgcctccaatcccatctgaccgcttcccgcaaacagatccaggaaatatgccccgggcacttcatcctgtatgatattaaacagcgtctccttgatccggtccgtggtcggtctcgtatccattccctccggtgccttaagcggcaggcttctcgccgttccagctatgattcgcatatggttccctcctctgtgatcgtgcgggcaagtaaatgaagcgccgcatctgtggcacttttccgcacctgcatccggtctcccgcaaacagatgccgttccgtgacaacccttccgtgcaggcagcagccgatgtagacaagcccgaccggacattccctggttccgccgtccggtcctgccacgccggtcacagacagcgccgcatccgtatccgccgtccgcgccgcagataccgccatatccgcagccgtctcggcactcacaacgccgtagcgctcaatcgtctccggcttcacatggatcatcttcaccttcgcttcgtttgaataggtgacatatccctccgtaaaaaatgcggagatccccggcacattgataagcgttgaggcaatcatcccgccggtcgcggactctgctgtcgtgagcgtataatgatatttttttaacaattcaaaaatccgatactccgacatttcatcaagcatcttgctgccgttctgtccctctgctgccatcttttcttccttctctatttctggtcttttaagacgtctttgttcttcacaatgtaatcgatcagagataccacggtcagaatcagcgccacatacgtcagcacggtgccgagaatctggaagaacggcatctggatgtcaaggatcagaacgatcaccatcagcatctggaacgttgtcttgaactttccccagtagcttgctgcgatcacaaccccgttgtcggatgccaccagacggaaaccgctgatgataaattctctcgcaatgatcacaatcacaatccatgccgccaggcggtcaagctcgatcagacagatcatggcagagcacaccagaagtttatctgccagcgggtccataaatttgccgaaatttgtcacaagattgtactttcttgcaatcttgccgtccagcatatccgtcaggctcgccacgataaagatcgccactgcaatatagttgccgtatgccgggaaataaggcgacagcagaaagaatacaaaaaacggaatcaaaattacacgcataatggttaatttgtttggtaaattcataacaattctcctatcaaatcatactcgtacgctcctgtcactctggcgcgtacaatatcaccggtcatcagttcctcgtccgtgttgatgaaaatgtagccgtccacatccggcgcatcgcggtaggtgcggccgatataggcattctcatcgctcacttttccttcgataaagacataaagctctctgcccttcatctcctcgttcttgtcgaagatgatctcctcctgcagttccatgacatccgcctgccactctttcttcgtctcctcgtcaatctgatccgggaactccgccgcaggtgttccctcctccggagagtaggtgaaagctccgagtctgtcgaactccatatcattgataaactgcatcagctcctcgtgcatctccttcgtctctcccggaaatccgcagataagcgttgtccggagcgtgatgtccggaatccgctctctcaaatgcgtgataatgcgcacaagatccgcgttgctggtgcgtctgcccatccgctttaacatggtatcgttggcgtgctggatcggcagatccaggtagtgacagactttctcattgcgggcaatggcgtcaatcagctcctcatagatctcctccggatagcagtacataatgcggatccagaacagtcccggaatctcatttaacgcatccagcagcttgtggagggacttctccccgtagagatccacgccgtaaagcgtcgtctcctgcgccactaaaatcagttccttcgcgcctgccgccaccagctccttcgcctgtgccaccagctcctccatcggaacactgcggtaattgccgcggatatacggaataatgcagtaggtgcagcgcttgttgcaaccctccgcaatctttaggtaagcaaagtgtccgcccgtcgtcacgctccgcttggctgtaagcttcggcagtccctccagcgtctcaaaattctcgtagaacctgccgcccagcgcctccgttatggcattcacgatatcttcgtaggaattggttccaaggatcgcatccacctccggaatctccttgcgaatctcttccttgtagcgctgcgccaggcatccggtcacgatcagcgcctttaactttgcatcgcgcttgtgctccgccatctccaaaatggtgttgatgctctcttccttcgcatcgttgataaagcagcaggtgttgatgatgatgatatccgcctgatattcatcatcggtcatctcgatcggctgtccgtcaaatgtgccggcatcccggatcattccaagcatgaattccgtatctaccagattcttgtcacagccaagggatataaataataacttcatcgttgtctccatcattgtattttaacgccaaaaaggatgataagcatatcatccttttcccatctgaaactatctgaaaaaatgattactcttcctcggactgtgactccggaataatctttaccttgccctcataaagttcttccacggcaatggataacggcttcgggcaggtgactttatctgccatcggctcatctccggcgatgatctggcgtgcgcgctttgcagctgcaatcaccagggaatagcggctgtttaccaccggttcctcaccgatctctacgccctcgttgactaccttcattaactctacataagatggatgtatcataataaatctcctttctgacgccctgttactgacgcgtgaagcctttcagctcgtttctcatttcacggattttgtctgcattgcgcgctacgcggtagtgctcattctggatgatctcatgcacttccctgaccgcttcctccagcacatcgttgactaccagatagtcgtattcctccagcccttcggcttcttctaacgcgcgtgccagccggtgttcaatgacgtccatggtctctgttccacggccgatcagccggttcttcaacacttccgcgctcggcggagtcacaaacaaaagcagcgcatccggaaactgtctgcgtacctttaaggcaccctgaatctcaatctccaagatcacgtccttgcccctggcaagctgctcttccacatatgccttcggtgtgccgtaatagttgcccacatactctgcatattccacaagcgcatcgtccgcgatcatctgctcaaacgcttcgcggctcttgaaaaaatactcgataccgtcgcgctccccggttcgcggtgcgcgcgtcgtcgcggaaatcgagagcgcgtaggtctcgctgtgtgcctgcatgagcgccttcatgatcgtaccttttcccgcaccggaaaaccccgatacgactgtcaaaattcctttattcttttgcatcgtcataatcctctgcggtattgccgttaaatcttcctgccagtgtctccggctgcaatgccgacaatataattttattattttcggtaaagatcacactcttggtgcgtctgccctgtgtcgcatcgattaacgtctccgtctccttgccgcgctgtatcagccgctttgccggagcggaatccgacgagatgatgcttatgatcttatcggtgttgaccatattgccaaagccgatgttgattaacccagccatggacgccacctactcaatgttctgaatctgctcacggaccttctcgatgtccgtcttcagattgatgccgacgtccgaaaccttaagatcggtcgtctttgagaggatggtgttcgcctcgcggttcatctcctgcgcaataaagtcaagctttctgcccatgccgccgccggcaagcagggtctccttcatgcttaagatatggcttctgagacgcaccgtctcttcatccacgcagatcttgtcggcaaaaatagtaatctccgccgcaattcttgcatcgtcgagctgtctgtcgcccaggagttcctgcactttgctctccagccgcatgcggtactcctccagaacctgcggcgagcgctcctcaatgtaatccacataggaaatcatgccgtcaagcttctccacgagatccgccctgagacgctctccctctttgatacggctctccacaaactgcactgccgcctggcggagcgcctgctccaatcccgcccaaagcttctgctcatccgggctctgctcctccatcacgaagacgtccggatagcgggacaacgtgctcacgcgcacgtcattctcgatgccgaactgctctgccatctccttcagataggtcatgtactgctctgcaagccccgcattgtattttaacgaataattctcttctgtgtaatcttcataagatataaatacatccaccttgccgcgctcgatatattcctttaacagactgcggatcgcactctcaaagaaattcagcgtcttcggcagcttgatattcacatccagataacggtgattcacggacttgatctccacggtaaacttgcggcttgcatccgcaacctccgcgcgcccgaaaccggtcatgctcttaatcattcactgtctccctaacatgatatcttctgatgctaattcgatttattataaatcgaatccggtttgaagtcaagagccgcaaaatgattccttacgacatgacagccattctctatgacatacaggtgccgcatggcatgccatgcggcgtgtcatgcggcatatcgtgccatttaggcatgtgtctcctgctcgtagggcatcacttccgccagaaagccctttttctgcagtgcatgctctatctcgtcgagcacttcttcgctttccgcggaaatcttgtgaaaatgatagccggaagtcacattcaaaagcggaaccgattttccggttctaagatcatttaaaaagccctgcacatcccgccggttcctgatattgagcgccgcttccacgcgcccgtaaaccctgtggttcaccatgacatttaagacggtaccgcccagatcaacgatcgtcgtgagttcctcctccacctgttcattggtatggcagaccttaagcacgcgggtcgcacatttcggttcgttgagcagatagcccttcgcggtcgacacaatcggatacccttctgttctaagcagcgcaatgtcctgcaccacgacctgccggctcacccccgtgacctgtccaagctgcgtcccggagagcggctgttccgactcccgcatcagaaggatcagtttttttcttctgtccgcaccggtcatttctttttccatagattttctcacccttccagcacacgcaaatgtttcagactgatatccaggatcggcgcagaatgtgtcagcgcgccgctggacacgtaatccacaccaagagatgtaatggtcttaatattttcctttgtgatattgccggaacactcggtctcggcacgtccgtcgatcacgcggatcgcttccgccatctgctccggtgtcatattgtcgagcatgataatatccgcgcctgcttccacggcttcttttaccatatcaaggttctctgtctccacctcgatcttgcgcacaaacggtgcatatgcctttgctgccgccacggcttccttcacgccgcctgccgcatcgatgtgattgtcctttaagagcacgccgtccgacagattatatctgtgattgcatccgccgccgatgcgcaccgcatatttttcaaaaatacgcatgcccggcgttgttttgcgggtatctaaaagcttcgtcttcgatccctccagaagcttcgccacgctgtgcgtgtaggttgcaatgccgcttaagcgctgcagatagttgagtgccgtgcgctctcccgacagcagtacccggatatcgccggtcacaaccgcaagggtctgtccctttttcactttctcgccatccttcacgaagaactccacctgcgtcttttcatccagcagtgtgaacacacgctcgaaaatctgtaaacccgcaatgattccgtcctccttgcagatcaactgtacgtcgccctttttgtactccggcatcacggcgttggtggagacatcctcactgttgatgtcctcctctaacgccatcttgatatatttgtcagcaacaagctgcatggtaattggattcatgttcttcttttcctttctgtgtaagttcgatcttttgtgcggcgcgctttgcaaaaacaaggctctccaggagactgttgctggcaagccggttcttcccgtgaaccccgttgcagcttgtctccccgaccgcatacagatgcggcatagtcgtttctgaatcgcgatccacatggacgccgcccataaaatagtgctgtgccggaacgatcggtgccggctcctttaagatgtcatagccctcttccagacatttctcataaatatgtgggaaatgtcccttgatgatctcctccggtacgttctcaaaggagatgaattcatggtcgacaccctctttttccatctcctcgcggatcgctttcgtcacgacatcgcgcggaagcagttcgttgacgaaccgctctcccttgtgattcaagagaatcgcgccctcgcctctggcggactctgagatcagaaagcttctgcccggctttttgctgtagagacaggtcggatggatctgcacataatccatgtgctccaattctactccgtgctgctccgcaatccggcaggcatcgcccgtcagaatcgggaaattcgtggagtgctcatacagaccgccgatgccgcctgtcgccatgaccgtatcctgcgcatggatgtgcagcgtctcgccgtcccttgtcttcgcgatcatgccgcagcagtgatcattcacgacgagaatatctgtcattacagtatattccatgatggtcacattcgtcaattttttcacatgcgaaagcagcgtcgtggtgatctccttgccggtgatatcctcatggaaacagattctcggtctggaatgtgctccctctctcgtgtaggcaagcgtgccgtccggattcttcgcaaaacggaccccgagggaaagcagatcatcgatgatcgcccggcttccgcggatcatgagatccacgctctccttccggttctcataatgtcccgcccgcatggtatcctcaaaataggaatcataatcgttctcatcatgcagcacacagatgcctccctgtgccagcatggaatcacagctctccagatcttctttggacagcatcagaatcttcttgtctcttccaagacgcagcgccgtatacagccctgccactccgcagcctgcaatcactacgtcatagtacatatctctcatcttatttattccctcttttcgtatcccggcatctgatacgccggtcacatttcatccgagtatagcacatatctttacagatgacaagacagttgttatgacaaattgtcaagacaatttgtcagacaatttgtcatgtataattccaaaataaaaaagacatattatcgaaaagggatgccgtcgcttcagaccaggttcccaaaaggagacaactatgattaacgaagataccatttatctgctgcgcgagtgcaacgccggaacgcagatggcagtctattccatcggcgagattctggaaaatgtcaaagatcagaagctgcgtgagattctgatctcatccaaaaaccatcacgaacagcttggcaacgaactgcatattctgctgcagaaatacggcgatacgacaaaagacccgggcgtcatcgccaagggcatgtcctggatcaaaacgaacgcaaaacttgccatcgacgacagtgaccgggtctgtgcagatctgattacggacggctgccacatgggcaccaagacaatgcagcggcacatcaaccagtaccttgccgctgaccgcgaggccagaggcaaggcagaagaactcatccgcatggaagaactgctcgcatgcgaactgaaaccgtttttatagacagaaaaaccctgcgccgcatccggaatttacaccagaaactcccggattttttccagcacattttccgtctcatcatagatggaaagtgtgagcggcacagtaagatccattgtgcagattcccagaatggacttgccgtccaccgtgtaactgccccgcccaagatcaaacggtccctcgcaggcacttaggatattgcagaatcttagtgcgcgctccggcgcattcagcagcacttctacctgtttcacgaataccatacctcctgtttcttttatggtatagtattccagactttccgctgccgtaatcaatcatttacatctttttgctagatcagtgtctcgatctcgtcgagcacttttccgaatacatcgagtgcatcctgaatcggcttcggctcctccatattgatgccgacctgttttaacagatctaccggagacatggagcatccgccggagaggaacttcttgtagcgctccactgccggtgcgccctcctcgagaatgccgtgcgcgatcgccaccgctgcagaaaagctggtcgcatactggtatacatagaaattatagtaaaaatgcgggattcttgcccactcataagcgatctgcggatcggagaccatatcctcgccaaaatacttctggttcagttcgtaatagagtttgcagagattctcagcatttaagctttcgccctcttccgccatctggttgcttttcatctcgaactccgcgaacatggtctggcggtacactgttcccttaaagctgtcgagataatgatttaacaggtaggcacgctcttttttgtccgtcgtgttcgcgagcagatactccatcagaaggatctcgttgcaggtagaggcaacctccgccacgaaaatcttgtactgggagtaaatataaggctgatttgcattcgagtaccaggaatgcatggcatgtcccatctcgtgtgcgagcgtaaacatgttgtctaacgtatcgttataattcaacaggacatacgggtgcgtgccgaacgcgcctgccgagtatgcaccgctccgcttcccctcgttctcatagacatcgatccagcggttctcaaagccttcctttaccgttgcaacgtagtcctcaccaagaggtgcgagcgccttaagcaccgtctccttcgcctcatcataggaaacctttttggctgcatccgcgatcatcggcgtgtagacgtcatacatgtgaagttcgtccaccccgaggcacttcttgcgcagctttacatagcggtgcatcttgtccatgttggcatttacggtctccaccagattgcggtaaaccttcaccggcacattgttcgcatcgactgccgcttccagcgtagacgcataatttctcgccttcgcatagaaaatctgctgctttacctgtccgttgtaaagtccggcaatcgttccggcaaactgtttgtagatgctgtaaaaagcttcaaacgcatcttttctgacgcggcggtcgcccgattcctcgaacggcacaaaattgccgtgggaaaggcgcaccttctccccgttttcatcctcgatctccgggtagatcagatccgcattgttgatgatggaatatacctgctccggcgtctgtgccatctctccggtcatcgccaccagtttttccatctccgccgagaggacatgctctttggtgcgcaggatctcatctaccagtccgcggtagagttccagttcctttttttcagcaaaatactgtgcaagcgtcgctttgtcggctgccagaatctccggcacaacaaatgccgtgcggctctgataatccgtcacaacaccgtacattttctgcgacattgcctgatgctcggtgttcttctgatcctggtcaaacaggcgctccgcataattaaacgccagatcgatcttctgctctgcgcgcgcgccaagctccagcgccgcaagaagcttctctgcggaagccataacactgccctctaactttgcgagatcagaaacgatcgcatccacttccttaagatctgcctcccatgctgttttagaagcatacatcgcacttacatcccatgtatattcctcttttacctcacttctttttggtaattcttttgccatagataacctcctgtccggtgtccccgttttcggtcgcaccgcataaaataagggttataaaatccctctcttaatttaccttccctaagccgaattgtaaagaccaagtttgttttttctaactccccgcctcctctttccatttgtattttgcggcgttttctactataatggattcacattatttatgaaggagtacaaacatcatggcttttgacggatttgtcatatccaatttagtatacgaattaaacaacacgattctgaatgccaaaatcagcaaaatcgcgcagccggaaaccgacgagctgctcttcaccttaaaaggatcaaacggccagtaccgccttgccatgtcggcgagcgcttccctgccgtttttatatctgaccgacgccaacaaaccgagtccgctcaccgcgccgaatttctgcatgcttctgcgcaagcatatcgcaaacgggcggatcgtggagatcagccagccgcacatggagcgcatcatcaactttaagatcgaacacttagacgagatgggcgatctgtgtcagaaaaccttaattgtggagctgatgggcaagcggagcaatatcattttctgcgatgcaaatggcagaatcatcgacagcatcaagcacgtatcggcggcgatgagttcgctgcgcgaggtcctgccgggacgcacctactgcattcccgcgacgcaggacgaccgtctgaatccgttggaggtcacggaggagacgttttgggacagcgccatgacaaagccgcttccgatcgcgaaggcgctctacacctcttttaccggcgtcagccccgtcgtcgccaacgagatctgccaccgcgcttccatcgacggcgacatgtccgtggattcgcttaccccggatgccaaaaagcatctctatcacaactttgcctggctgatggaggatgtaaaagagcaccgctatgagccgaacatcatcacccgcggcagggagccggtcgaattttcctgcttccgtctgaccgaatatgtcggcagcgatgatgccgtggaagccacaaattctactgttgccacggattccgccggcaacgcaggttttgccggtgcagacgcaaacgaaagcgaatacacgatgcagcacttttcttcgatctcagcggttctggaacagtattacgcctcacgcaacgtctacacgcgcatccggcagaagtccgtcgatctgcgccggattgttgccaccgccctagaccgcaaccgcaagaaataccagctgcaggaaaagcagttaaaggacacggaaaagcgcgacaggtacaaagtctacggcgaactgatccacacttacggctatggacttgcggagggcgcaaaggaactggaggcgctcaattactacaccaacgagatgatcaaaattccgctcgacccgatgcttgatgccaaggcgaatgcccagaaatatttcgacaaatacaataagttaaagcgcacgtatgaagccctcacggatctgaccgcggagacgcgcgccgagatcgaacacctggagagcatcgcaacctcgctcgatattgcactcacggaagacgatctcgtgcagatcaaggaagagctgatcgaatacggctatatccgcaggaagcgcaccgacaagaaggccaagagtaagagcaagccgttccactaccgctcctccgacgggtatgacatctatgtcgggaagaacaattaccagaacgaggaactgacgtttaaatttgccaccggcaacgactggtggtttcacgccaaaggaatgcccggctcccacgtcatcgtaaaatccggcaacgacgaactgccggaccgcgtctttgaggaagccggaagactcgccggttattattccaaaggcagggacaacgacaagattgagattgactatctccagaaaaagaacgtaaaaaagccgaacggcagcgcgcccggctttgttgtatactataccaattattctctgaccattcacccggacatctccgggctgaccctgatcgagtaaaagcgccctaggcttcgatcagtcctgctctgcgcatctctgtgtatgcgagcaggaacgggccgacgccctttgcatcatcttttaccaccggctccgacatataataatcgtaggtgccggagcgcatctgttttccgccaagtccggcaactaagcagatgccgtccaagtgcaggcttccgtccgcatcctcagagagatatttctcacagatgccgtggaatgcctttgcaccgtatgtctgatagttctccggcagaaagcccaggcgcacgcccttaagcagcgcgtatgccatgatcgagcttccgctggtctccagataattcttttccatgcctccaaaattcacaacctgataccacatgccgctggcgtcctgatactttaacatggcatccatcagatccacaaacacgccctttaagcgctcatacggctcgccaaccgacgcgtccgccttgtccaacgtatcaagaagcgccatggaataccatccgagcgctctcagccagaaattctggcttaatcccgtcaccttgtcacaccagaacatctctctggaagaatcgtaggcatgatagtacagtccggtcttcggatcacgcatatgttccaccacattgaaaaactggcggaaaatatcgtcgtagttcttcttctcatgaaatctcgtctcatactccatataaaacggctgacacatatacagtccgtccagccagacctgattcgggtaaatattcttgtgccagaaatttccctctgccgtgcgcggcatctgctcaatctggctgtatacaagatcaatcgctttgcggtatttttcttttccggtcagatcgtagagttcaaacagggttttccccgcattgacattgtcgatatttaactcttctaccgaatagccttcaatcgagccgtcctctctgaccttgcagtcgataaaattgtcggcaaagcgaaaatatttctcgtcttttgtgatcgcatacatctcaagaatcgccttgatcatgcatccgtctatgtaattccaggtggactttaagccctgcagaatcttctcaatattccagatcgggcggtccggagtactcttctccagcaattcgtcaatataggtttctattttgtccatgttctgctcctttatctcggggatttttcaaaaaacatccccttgattatagaagaatttcggaaactatgcaatagatatccctctcttttccagtggtgcatctcactcggcattttttaatgcctgatccatcggaatttttctgatccgcataaagtcaaacatcatcacgatcagataaccgatcagaacaaacgcgaacattttcacatagcccgccggaagaatgacaaaggaaaaccatccgctgtaactgtacatgatcactttccatgcggcattcatcacgagcgcgccaagcaccacgcagattgcatccgccacgatcacaacaatcgtggtcgacagcagataaatgctagcaatctcccggttctcatagcccaggatctttgtcatggaaattgccgtctcattcttctcaataatgatctttgtgagaagatagattaacaccgcagacagcaggatgcataagatctggaaataactcatatacgatcccatcgagtggtccagctgatcgcacattttcgtgatgtcctgctccgtaattaccgtcgcgatattttcctccgcaatgtccgtaatctccgtgtccgagaaataaccgccaaacgcatccgcatcctgttcaaatacctcccggtaattttcaatcggcagaaatacggcaatgctctgggacttgtcaaaaatgcccgccacccggaaggtatactgctgattctcgtacttttcatccagtgtgacatcgtcgcccacagagacatcgtatttgtctgcataggaggcggaaatatatgcctcgttctcttttaaataattaagatcgtcgatcttcacatactgactttcatcggagatgccgtagaccgatacctcctcgtcgagcgtatcactcttccgtaaaagagatgtcatgctgaatttttccgcacccggctcctttgttgtgatgatgtcgccgtcctcatcctcccaggacgcaagcacatactgatactttgcgaacatcagatccttggcgttctccttatagtagctgagcgtatccggcatgccgaccgccatcgccagcatgaccatgcagaaaaatatcccgacaaaaaggaccgcataatttgccatattctgaaacatgacgcgcagacggaaacggctcaaaaactgaaaccgcggcaggagcatcgcctttttacgctttgtcttctttaaatcatgccgcaaaaactgtaacggcatatggcgcatcatccgcgcaatcaccacaaggttcacaacaaacatcagaatcagcggaatcagcgtcgtctttataaacgcatccggattccatatcgtctcgtaggtcggaagactgtagctgttatagtacatcgaaaccacaacatttttgaacaccgtatatccgagaatgtttccgatcagcgccgcgacgagcgtcacaatgaccggcatcgacagataatgcgccaccagttccccgcgcgtgtaacccgaagcgcgaagtgttccgatcgtggacgactccctggcaatcgtgttgctgattgtaatggcaaaaataaaagcgataatcacaatcagaatatcgagcagcacaccgcccatcgcctcatcagagcccatgtcatccgttgcaaaatgaatggcagggttcgcatattccggaacataatcctcaatctccgcatccgcgacaaccacctgcgtcagcagggctttcataaaatcatccgacagatttttttctgctgcctcatccgccggctctgtcacatagttccatgcataatcatagtgcaccttctcgtgcaggcgcgcaaacccgtcttccgtcaccatcgccacattgaatttcagcgcatcgaacatcagatccgtacttttttcatgcagtgtggcatagttgacataggcaatcagtccgacgacacgatacgcctctcctccaaccgttatggtatctcccaccgcaatgccgacattgtccgcatgcatgcggtccaccgcaatctcatcagaagatgccgggaagcttccctccatcaggcatgccagattgatgtcatctgtcttctgatagacgcggacggttccgtccgagacgccgtcgccgtcgtgatcctcctcctcattgcggtagaaattctcggatatgttcaccggaaccgccgcaaaatcaggatagttcaattcgtatttgtcttccgccttttgatatttttcatcaatttcatccagaatcttgtcccaggcttcgtcgtaagccttctcgtacgcctcgtcatgtgccttcccatacgcctcgtcataggcggtatcgtaggctttctgatacgcgctctcgtaagcggcatcgtaggcctgctgataacttcccgcctgctttgcctgcgccaccgccgtatctagcatcgctgcagccatggtctcatccatcccctgtgccagcagtgtctgttttacctgcgccgcaaatgtctggtcgaactgtgtctgaaattccgcattgaatttccggtcaaattcctccttgaactggctgtcgaattcgtccttgaacttgtcctcaaattcatcgtcaaacttctcatccagctcacgccttgccttgtccgtgtaatactgctttacatccgctttctctcccgtggcaatcgcggcgagcagtgtctgatccgcctcctcattcagttcaaaatgtccgtcctccagcttatatttcgtgactccctcatctgcagccttcatcatgctctcgttggcaacgtacattcccgatacaaagccgattgtcaaaatgaggaacaggctcacgagcagatattttctccagtctcccgccagttccctcggtatgcgtctgatcagcggatttcttgtctttttcttcttcatgccggtcacactccttaccattccagatctgccgctgaaactttatccgtgttgatctcattgtgacgtacttccccgtcgcgcagcttgatcacatgatctgccatatgccggatcgcctcgttgtgcgtaaccataataaccgtattgccgtattttatattcacatcctcgatcagctttaagatctctttggacgtatgataatcgagtgcgcccgtcggctcatcacagagcagaatatccgggttcttgacgatcgcccttccgatggatactctctgctgctgaccgccggagagctgattcgggagcttgtatctgtgctcataaagtcccagcgtatgtaacagttcatcaatatccagcgcatgatcggacagatacgcgccgacctcgatattttcctttacgttcagattcccgatcaggttatacatctgaaagacataaccaagatgcttgcgccggtattgcgttagtttcttctcactcatctcctccagcttatcaccgccgatcgagatataaccggaatccgcgctgtcaatgcctccgataatattgagcagcgtcgattttccggagccggacggtccgagcagcacgcagaactctcccttcgccacggaaaagttcatcccgcgcagtacctcctgccgtgtctcgccgcttccaaatccctttttcagatcaacaatttccagaaatttcttttcttcctccgacataatctcctctttccggaacatccccatgcaggaatattcctgtttcctttttgcagacagccgttagctttaactaactttttcacattatatcatagtcccgcaagattgcaagaaccaaaccgcagggaagcctgtacaaaaaatggaagctttttcctgtttttttgacaaaaactgcatgtttatctctcttaaattctcacatactattcctgaacaaacgcagatggcgcaagttcagacgaagtctgtgaccaaaaagtctaagacagacaaagtgatcataacaatgataacaaaggatcattaacacaccaaaggaggaaacaatcatggcaaatcgttcatctaacagagcagcaatccctgaggcaaaaagtgcactggaccgcttcaagtacgaagtggcgagcgagatcggcgtgccgttaaaggacggctacaacggagatcttacctccagacagaatggttctgtcggcggttatatggtcaagaaaatgattgaggcacaggaaaagcagatggcaggcaagtaacccgcccgtcgcagacattccgagaaagagaaaaaaataccaaagaaaaagacgggaccggcgcttgcaccggtcccgttttatgtgtgaaattataagctcatctgattctgttcccgcataaggaaagcttcgagataatgccgcaggttctcatgctcaccggacataagatccggatcttctgcaagcagttcgccgaccgcctccgatgcatcccgcagcacggcagcatcctgatagatgtcgccaagtgcaaactgcagttcgccggactgacggatcccgaagaaatcccccggcccccgcagttttaagtcctcgcttgcaatccgaaatccgtcattggaatcatttaagatcttaagtctgcgctccgccgtctttgcgctcgagcagttcaccataatacagtaggactgtgcatcgcctcttcccacacggccgcggagctggtgaagctgcgccaggccgaaccgctccgcattttcgatcatcatgaccgtggcattcggcacattgacgccgacttccacgaccgtggtcgccaccagcacctgcacctcatttttcataaatgcctccatgactttgttcttctgcgccggtttcatttgcccgtgcagcagtccgagctgaatctcctccggaaaaatctgccggagtttcttgacgtagtccgtggcattctccgtctccatgccctcgacttcctccaccagaggacagatcacgtatgcctgatgcccgtttttgacctcattttcgataaatgcatacgccttgttccgatagcccgtattgaccacgcagtttttgaccggaagacgctttgcaggcacctcgtccaccaccgagatgtccagatccccatacaggataatggcgagcgttctggggatcggcgtggcgctcatcaccagaatatgcggatgtctgcccttttccgcaaatatttcccgctggcggacgccgaagcggtgctgctcatccgtgatgacgagcgccaggttatcgtagatggcgcgctcctgaatcaacgcgtgtgttccgaccaccatcgcattgggataaagctgcagcgcctcgtatgccatgcgcttctgacgcgccgtcatggagccggtgagaagcaccaccggaatctttaatccaaactcttcgcacaacttctgaaacgtctcatagtgctgtctggcaagcacttccgtcggcgccatgatcgccgactggtaatcattgtgcgcggcatctgccatcgccaaaaacgctatgatcgtctttccggaaccgacatctccctgaatcagccgctgcatgacataagggcttcgcatatcgcgcttcacttccgagagcgcccgcttctgcgcgccggtcagctcatacggcagcctggcaatcagctcatcagtaaaggaatcctcccggaattcaaattcgttggcttccttgatccgcttctccttgtggtactgcatatttaaaataaagaggaaaaactcatcgaacacgagacggttgcgcgccgcgatcagcgtgtccatattttccggaaaatgaatctctttgatcgcataattgtactcgcagattttgtagcggctgcggatctcccggggcagatattccttaaacagttcttctctgccgagcaccgagcgcacggtctttgtgaccagattgttcgagattcctccagtcagaccatacaccggcaaaaatgcctgctccatggcggcgtacgcttccccggaatagatggctgcctgctccatcacaagacggctgcctttgcgcgccaccttcccgtaaaatacataggtattgcccggtgcaagctggcttttgatgtatggcatccgaaaccacaccagttcaagttccgcctcatccgtgccgatggtcgtcaccgtgaccggcatgcttctcgtgcgtctcacaacgggcgtctttctcaccctgccgagtaccgccgccgtctcgccgtccgtgacctccgccacctcttttgctaccgggaactgcacatacgtcctcggataatgaagcagcagatcccccaccgtttcgatatttaatttctggaacagggcggctgtcttttccccgattcccttgatctctattatggatgtactctgattcatactctgtttcccttagaaaaaggctgccgcaccgtcaaccgcctcaagcgatgtccgtgcagcagccctgcctgtgcttatgttatttacacttttcgtcttactcgacggagatcacgtaataatagatcggctgtccgccatagtggacttccacctcgacatccggatgcgcctctgtgatcttttcaccgatcgcattcgctgcatcttccctggcatcctccccgtagtagatgctgacaatcgccgaatcctcatcgatgagctgttcgatcatatccaacaccgtagcctcaagctccttcccaacggcaaggattccctgatcgccgatgcccataaaatcatcctgcttgatctccttgtcatcgatcacggtatcgcgcaccgcataggtcacctgaccggtctttaccgtccccagttcctcgctcatgcgctctgcattctcctccggtgtgctgtccggaatatagttgatgagcgccgtgattccctgcgggatcgtcttggtcgggatcacgatgatctttttgtcctccacaagagaggctgcctgattggctgcgagaataatattcttgttatttggaagaataaagatattcttcgcgttcactttttcgatagcgtttaacatatcctcggtgctcgggttcatcgtctgtccgccctcaataatgtagtccacaccaagtccctgaaagatctcattgataccgtcgccgatgctgacagagataaagcccatctccttcggcggttcctgctcttttggagcttcctcgtccttcagctgcttctccacgtcctcgatggtctccgactgcatctctttttccttgagtgcagagatcttctcgtcacgctctaacttcatattctcaatgatgatcgtcgtaaggcttccgtaagtcagaccgcgctgcatcgcaagtcccggatcattcgtgtgcacatgcacctttacaatctcgtcatcagcgacaacaacgatcgaatcaccgatgctctctaagtactctttgaattccgtctcctgtcttgtggaaatcggcttctccaacataatcaaaaactgggtacagtacgcaaacttgatctcctgcgctgcctgtgcctcaatgttgtaggaggcgcttcccgtctcggccgccggctgcttctccggtgtctcaatcgagtaatcgatctccttgccctgcagggagtcaagcgcacccttcatcacctgcatcagaccctgtccgccggaatccacaactcccgcctgttttaataccggaagcatatccggcgtcatgctaaggacatgatcgccctctttgatgacttcctcgcagaacgcaagcagatcggtcgtctcctcctcgctcagctctaccgcacgtaccgccatccctttggcaaccgtaagaatcgtaccttccttcggcttcataaccgccttgtatgcggtctctactgccttctcaaacgcatcggacaatacctgcacgtcaatctcatcatactctgcaataaccttggtaaacccgcgaaacagctgggaaagaatgacgccggaattacctctcgctccgcggagggaaccggaggaaattgcctttgcaagcgacttcatgtccggctctgccatcgccgccacttccttcgcggcagacatgatcgtcatcgacatgttggtaccggtatctccatctggaaccgggaatacattcagttcgttgatccactctttctttgcttccaagtttttcgctccggccagaaacgcttttgcgagagcctcggcatttatcgtagtgatctccacctcaaaaatcctccttaatcaatcactcgtacgccttcgacgtagatgttcattttcttaatttccattccggtaaacgcctcgaccttatattttaccgtctcgatcagattatcggataccgtgatgatgctgacgccgtaagatacgatcacatgaaaatcgatcgtgatcttgttctcctcatcaatgacgacattgatgccgtgcgtgagataatccttctttaaaagcttcaccagaccgtccttcatgttgactgcagccataccgacaattccaaaacattccactgcaaccgatcctgcatacgttgcgatcacttccggatctattgtaaccttgcccaactgggtctccatatgtccattcatataatacgatgctcctttcaaagccatattaacgctagtttattgctattataaccgctttttgcacaaattcatagccctgttttttgaattttatattttttttaaattttgcttgcaatatgtactttcttctgatagaataatcatgttgtgagcctgtatgctatacaggttttacctgtagaatgtgcgggcaagtcctgcatcaccaggataaaatatgcaaggaggtgcaaaatcatggcaaaatgtgcagtttgtggaaagggcgctcatttcggtaacaacgtgagccattctcatagaagatcaaatagaatgtggaagtcgaacatcaagcgtgtcagctgtaaagtgaacggaacaccgaagaagttatatgtatgtgcttcctgtttaaagtccggcaaagtagaaagagcttaggaaaagtaataacatctgtttcagtcctgctgattcagatgttatttttttgtactcttccctttccataatcgaaaaaacatgactactagaaactgtataaccatcttgatctttcacttccgccttcaattgaaaaaacttatctttatcttcattaataaattctctcattttctggcgtgtaaactgagtaattttatcttacatcagtttggaggtttacacaaactttgggatgctcccgaggaattttattcatataaaaatggagctcttgttttttactcaaaagctccattactgtttatttatttgaatttatgatttcttcaatatcacgaccaccgtagaatattcgagctactgtaactgcccttttttcgtcatcaaccagataatacacaataaaattgtctaccggaagctgatgcattttcatcgaatgccaaggttcccaatgagctaacgcatagcgagctggcatgaaatccaatgagcgcacctcttttcggatgcagccaagctgagcagaagcagtctctggaacaaggagttcattcgcaatgtatgaatagatctcgcgtaagtcgtcaagtgcatctacagaatagccgaccttatagctatctgtcatatgccaaactcctttgcaagtgccgcatcgacttcatctgcagaatatacctttcctgctttgatggaatcaacacccttctggagttctgcatcaagctgttttctggtcattgcaccaacagctaatggcttagaagaaggaagtttcagttcaaatggcatacccttcttcagtacaatctggctataaagcatctgaattgcactggatggagaaatgccaagctgagaaagaatgctctcagcattatccttgagattggtatctattcttgcataaacagcggatgtatttgccatagtatcgcctcctttttctttactatattcgcatttgcttgcgattgcaagcatttacatagattattttatgacgaaactttgaattttatacgccctttgcagaagaaaggaatatttatgaacaagcaccatcaacaaaattctccgtaacgaaaaatacatcggtgatgctctgctccaaaagacctacaccaccgactttctaaacaagaccagagttaaaaataacggtcttgttccacaatactatgtagaagacgaccacgaagccattattccgaaagatatttacctgcagggacaggaagaactggtgcgatgctggatcaagcagatcacgatctgggatgaccgcatcacagttgaattaaaatccggcgtcagcattgatgcagacacataacttcatagacgcacgaaggctcctcaccactggataatttccggcgatagggagtcttcattgtttattctttcatgcatgaactccacttttatatagaatttcagtaaaagttgaggtttgccccagattgtggggcaaacctcatgaattatcttacacactttctgtattcatatttacactctcttattgacaatgtacatctcttccataaactctttataagttttaatgattttctcctttgaatacttctctttctcgacttgatgtaaatatatatgccttgttgaccccgtgacctgtattcgttcctgctgatcgcaaatacccgttaaaagcatcactgttattaaactgatcctgcaaacctctgacgaacaggcaacggatatgatgtttcgcttggtcgagcaaatggctgacaaagagggcgtgaccgaacaactaaaagtagaaagcccgatgttatgggttggaagaatgaatgagatacaagcaagggcgagagaaattgtatatcaagaactgatttatacctaaaaagagggcgacagcatttttgctgtcgctctcttaattaccatattgtaaggacagtcggggctgtcaacggttgagggcagcccatttacttgccgttgactggctcggctgactttgctatctcgtttagtattcctttttcttgaaaatacggacagtcaaaggaaaagataggataaatagcaatatagaaccacttattaaaataaactgtccaaatgacggtatattaaaaagcattgcagcaataccaactgcggaaagcaaagatatgataagaaacactatcagtttatcttcccctgctaaataaatgctaggaataaatattgcccccattgaaaggcttatgctgagtcctaatataagtacacctgctataccttcaaactggttaaaaggaactccatgtaacagataggataaggctgttatactaccaacgaaaagtgtccctatcacaatccacaataactgattgatgtataagccttttacaatatcaatcctttttactggcaaagtgagcttatatttcccccattttgaggaaaattcatttccgatagcagtagctgcatttactgacaatccaacaattccaataattatgaaatacatttgccatgtctggtctgggataatgataacgacaatacccattacaagcataaaaaataaaaatatttttgcatttgtccatacggcaagaaaattatttttgaaaagccctttcatatacgttcccccctcgtaccaatagtaaaaagatatcatcaactgaaatgtggtctatcaccgtatctttgtattttctctgcattgctttacaatcagaaactaggacatcaatttgaaaatcacgctttcgataggcaataatatctgttggatctaatgcaaggaattgattttccttacaacgcataaccgcataattgtaaaccaaatcatttttcgatacggtcataatcattttcccgttatgaataaatgtaatataatctgcaactttttctaaatcacttgtaatatgagaagaaagtaaaatagaatggttttcttcctgtacaaaatcaaggaacgtatctaacatctcatcacgaacaatagggtcaagtccgccagtagcttcgtccaaaataagcagttgtggatggtgtgataaagcaaccgcaatcgctaatttcattgtcattcctctggaatattgtttgattttttgatttgcaggtagtttatattcttctaaatacttcagaaataagatattatcccattgtttataaaagcctgccataacttttgctaattgtgtagccgtccaataagtcgggaaattatctccgtcataaacaacgcctattttttcacgcatatctgtgtctgcgtctgacatttcctgtccaaacagttttatctttccgctgtccttttttattgtatttaatatgcaaccaatcgtcgttgtttttcctgctccattttctccaacaaaccccataattgccccatacggcaagttgaaggacacattttccaatgaaaattttgattttgaaaatgtcttggaaacctgctgtaattctaaaatattttccatgctattcctccgttttataaaataaagttaataattctgtcaatttctcaagagaaatattgtttgttctcccgatttcggcagctatttgtaaatgttcttctgctatacgctgctgttcttcttgataaaattctttgttttgtgcagatacaaaacttcctctaccaaccgtggtttctatgaaaccgtccctttgcaaatcttcataggctttctgaacagtaatgacgcttacctgaattgactttgccaatgctcgcattgaggggattgcgtcaccagctttcaattcgccactcattatcatggctttaatctgtgatgtgatttgctcatatatgggcttgttggcattattactgataatgatttccatacctcaccgccttttatttcacgagtgtacttaatgtgcaagtacattatatcatctatacaattttagtcaacccaataaaacaaaattgtgagaagaaatgagattgctatgtatgccgccgctatgggtaacaccataacggcgttttttcaatgcctattggctatctctgtcaaaggattttttgcggtggcttttgtctgtttcgctcctgtattgtatctcgtgcagatgtttgagtacactctgcttttcgggcggtctgcgctgttctttgttggcggctgcggattttcttctgctttggtattcccactcgacaagatcacggttgtattgctctacaacactttccatttctcggaaaatacgcataaacgcctgtacatcgggataaccgtctttcttcagaacatagggcagtttttccagcttctcagatattttcttttcggtctgctctatctgctcggtaagacttttacgctctttgcctttgaatattccttttacttcggcaagctgtgattttaactttggcagtacctcgtcctgcaagtgtttgatttccgccgctttgtcctgcgcctttatcatcagattccgcatatggcgaaactctgccatatcaatatcaagcgtaggcttgggcagcatatccttttcacggataaggttttgcagaaagtcttttgcctttgccacaatccctcggaacagattaggcagccagcctttgctcttgatagattggcttgctttttcgtgtatctcggtctgcttgacctctaaaatctttgcgccatatccgctgtcctgttccattcctgtcttgcggtattgtccgcttcaatctcggcggctttggggttattcatgccgattttcttggtaggaagataaacgctgttcttatcaaatacctttaactgttgttcgagatcagagatatgccgattgataaggtcggtataaatcgcttttacctcccgaagaaaaggctcgctcttgaatttatcgtctttcacggtaaagaggtgactttcgtaaacctcgctctttttaatgacggtacagcctttccgtagtgacagcagccgaagaacggattgctgaaaaagaaaaattccgtggcactttgacaagtgaaaatgccgattgacattcaccggcataagtgacactattattttacgcacaccatatgtcacagtcccgattgccacggatagaaaggggaattttatctatggcaaaaggttctgtaagaaaaaaaggtaaaaagtggtacgctcgcttttacatcgaagatgaaagcggcagaaaagtacagaaagagtttgtaggaacagaaagcaagtcggaaaccgaagccctgctcagaaaggcaatcgctgactatgaggaaaagaagtttgtcgggaaagccgaaaacatcacggtaggcgaaatgctggatatgtgggtggaggaagaattaaagcccggcaatctcagcaacggtacggtcatggcgtacacgacggcagtcaaaaagattaagaaatatcccattggcagccgaaaactgaaaaccgtgaccgccgaccatttacaggcgtttatcgaccttatgagctacggcgggataaacccagacggtacaacttcaaagcctatgagcaaaggctatatgctgcaattctcggcgatgctgcaagactcattccgttttgcggtatttcccaaaaagctgataacctttaacccgatgcagtatgtaaaactgcgtggcaaaaaagaggaaacagatattttctcggacagcgaggaagaaactgttattcctacgattacacatggggaataccaaaagctggcggacttcttaactgggaagaaacacccagcgctgcttgcggtgcagatagcctattatgcaggcttgcgtatcggagaagtctgcggtctgacttggcaggacatcaaccttgacgagcaatatctaactgtaagacgcagtatgcggtacaatggcacaaggcataagcacgaagtcggcacgacaaaacgcagtaaagtccgtaccgttgatttctgcgacacattggcagacatcttacggaaagcaaagacggaacagcataaaaaccgtttccgctatggcgaactgtatcatctgaactactgtaagacagtcaaagaaaaggggcgcacctattacgaggtttacagtctgcaaaggacgcagggaatgcccgaagatgacagggaattatcctttgtctgcttaaaggaggacggtgcttttgtttctgcaagtgcagtcggtcagatttgccgcaaggcaaaggcagaggtcgagggattggaggactttcatttccacacactccgccatacctacacaagcaatctgctttcaggcggtgcaaaacccaaagatgtgcaggaacttctcggacacgctgagtcagtaccacaatgaacatttatgcccactctaccagagaagcaaagcggacttccgcaaggctcttggataaggttgtgggcgaagcataaaaaatttcccttgtttcggctcataagggcaaaaacaagggaaaatacataaggttttgatatttgataggcggtaagccttgaaaactcaaggaatttcggaagattgaatttttaatatcaatttatgcaaaatcaaacagcgacagctggttcgactccggcagttcgccgagcagtcccagatctgccataagatcgatgaccgtcttggtcgccttggtgcgctgcctgaagtcgtccttggacagaaacttgccatccttcgccgcctcggcaaccgcaatcgcagcattgtcacccataccgtcgatcgtgtttaacgccggcatgagtttgccgtcaatcacctgaaaacgatccggctttgcgcggtacacgtcgatcggcgtaaaatcaaaccctctggcatacatctcctgcacgatcttcatatcgcggtaagtatcctgctcctttttggagagcgaatcttttctccgcgtgtaatccttgtaaaaatattcaagacgctccttgccctgacacatgatctcgtagttaaatcccgtcgcacggatcgagaaatatgccgcatagtaagcaagaggataatataccttacagtaggcaatacgccatgccatcataacgtatgccgccgcatgtgccttcgggaacatgtacttgatcttcagacacgaatctatgtaccactccggcacatcatgcgcacgcatctccgtcttccactcttcctttaagccttttcccttacgcaccgactccatgatcgtgaaggactgctcactgtcaagtcccttctggatcaggtagatcatgatatcgtcacgggtacagatcgcggtggaaatcgttgccagtccctgctcgatgagtgtctgcgcattgccgagccatacgtccgtaccgtgggacagaccggagatacggatcagatccgagaactcctgcggcttggcatcaataaccatctgcatggcgaaatcggttccaaactccggaataccgagacatccgagcggaattccatgaatgtcatccggcgtcacaccgagtgccgatgtatttttaaataaggacatgaccgactcatcgtcgagtgggatcgttgtcgggtcaattcccgtcagatcctgcagcatacgaatcatcgtcggatcatcgtgtccgagaatatcgagttttaacaggttgtggtcgatcgagtgataatcaaaatgtgtcgttaccgtcgctgtcgtcatatcgttcgccggatgctgtaccggcgtaaacgtgttgatctcctctcccaccggaagcacgacgattccgcccgggtgctgtcccgtcgtcctgcggacgccgacgcatccctgcacaatacggtcaatctcacagttccgcttgtggacaccgcgctcctcgtagtaattcttgatgtatccgaacgccgtcttgtccgccagcgtaccgatcgttccggcacggaatgtctgaccgtatccgaaaataacctcacagtaggcatgcgctttactctgatattcaccggaaaagttcaggtcgatatccggctccttgtttcccttgaatcccaggaacgtctcaaacggaatgtcaaacccgtcttttaccagcttcttgccacagaccggacagatcttatccggcatatcacatccgcttcgcccggagaacgccttgacctccggcgaatcaaagtcgctgtacttgcagtaggcacagcggtaatgtgcctgcagcggattgacctccgtgataccggacatggtcgccgcgaacgaagatccgaccgaacctctggagcctaccagataaccgtcctcgttggacttccacaccagtttctgtgcaatgatatacattacggcatagccgttggaaatgatggaattcagctcacggtccaatcgctccttcacgatggacggaagctcctcgccgtacatgctgtgcgccttggtgtagcagatgtcacgcagcatctgatcggaattctcaatgaccggcgggcacttgtccgggcgcaccggtgcgatcttctcacacatatcggcaatcttgccgggattcgtgatgacaacctcctccgccttggtgcttccgagatactcgaactcctttaacatctcctccgttgtccgaaggaacagcggtgcctggtcatcggcatccttaaatcccttgcccgccatgatgatacggcggtatacctcatcctccggatcaaggaaatgcacgtcgcaggtggcgaccaccagcttgttgaatgtctcgcccagctttacaatccgccggttgatatcctgcagctcctcgacagagttgatggcgctcttctcatcccgcagcatgaaactgttgttgccgatcggctgaatctccagatagtcgtaaaacttcacaagacggatgatctcctcctccggtctgccgtctaaaatcgcacggtagagttcgcctgcctcacaggcagatccgagcagcagtccctctctgtactttacaaattcgctctttggcacacgcggtgtcttgtgaaaataggtcaggtgtgacatggagaccagacggtagagattgatgcgtccgatatcgtttgtcgccagtatgatcgcgtgatggctctttaactttttcacaagttccggcgacgtcgcgcccatctggttcacatcgtctaacgtctccatgccgcgttcatgaagcatctcgataaacttgacaaaaatctccgccgtacatgccgcgtcatcgaccgcccggtgatggtgatccagcgatacaccgaccgcctttgccacggtatccagcttgaaacggtttaactgcggcagcaggattctcgccagcgccacggtatctgcgatggtaaaatcaaacggcagtcccatgcgctcgcagttcttgcggatgaatccggtatcgaactccgcattgtgtgccaccatgacggtcccctcgcagaacttcatgaattcgggcaggatctcctcaatcctgggcgcatcgagcaccatgtcatccttgatggacgtcagctgctcaatattatacgggatcggcacctccggattgacgaaggtcgaaaaacgctccgtgatagctccgtccaccaccttgacggcaccgatctcaatgatcttattcttatccggcgaaagtccggttgtctccaggtcaaatacgacatagctgtcatttaagctctgtccttttgagtcaacgataatatccttcagatcatccaccagatacgcctccacgccgtagatgatcttaaaatccgaatccggcggaaccgcatggttcgcgtcagggaaagcctgtacatcgccgtggtccgtgatggcgatcgccttgtgtccccacttcatggcgcgttttacaatatccttgacatccgagacgccatccatatcgctcatcttcgtatggcagtgcaactccacgcgcttctccgggctggtgtctgcacgtgtggacgtaaaatccgcaatctttttgatgccgaccacagaaccgatcgtaagctcactgtcgaacttgtcgatcgtcgtcacacccttgatctttaaaaacgctccctttgcgagtcctccgtcaagcagttcctgcagctgatcgtttctggtaaagatttttaacacaatcgaatcggtaaaatccgtcacggacataatcacgatcgtcttctcattccggatctccctggtctctaacgtcatgacctggcagcggatcgtcacctctcccatctctcccacaatcttctcgatcgcgatcggttcatcctcaaaatcacgcccgtagatcacatccggattgtccgacttcttaaggccgccgccctcgaatctgcgcttgaattccttcttccctttttcgccatttcctgcagtttttcctgcatgttccgcaggttttgcagcattttttgcagaagaaacggtatttgtggtggcattgccgcctgtaccaccagatgttgttgtgccatcggaaaccgcctcggcaccgccttctgcgaccgccggcacactctccccgtcgccattgcggatatgtacctttttcatgatgtttttaatctcaaactgaatctgcagatcactgtttttcttatatttgctttccttcggttcctcgtaggcaagctccaccgccagatcgagtccgcagcgctcacagatcaccttctctaaaaactccacgatctcatgggaacgcgtctgtgcgataatcgtattctccagcgtgagcagcatgtggctttcgctcgtaaactccatcttcgccgtccgaagaagattgtattccatcaggctgtaatctttcagttcttctaaaatgctgtcgcgatacagatcaagcagcttttccggcgtatactgttccgagagatgatacttttcaatgaccttgacctgcatcatcctgcccttaaaaatctgttgtgcaatggcagattccaactggcggatatcttttttgtgaatcagacgcgtgctgcttaaatagacgcgcagatgatcgcgctcatgattcatgcccaccttcgttacttccgtctccgtcagcagatttttcatgtcgccttctacctgcagtgatggaaatacatcaaaaaaccgttttgccatgcccttttctcacttcttcctcagtctgttctacttctgctgctcattccagtgcagcagctcatagcgcaatgcctcaagcagttcgccctccggcacctttttatatacttccccgttcttgatcaaaagtccctctccgattcctccggcaataccgatatccgcttcctttgcctcacccggtccgttgacaacgcagcccataaccgccaccttgatgtctaacgggatgtctgccaccatattttccacctggttggcaagcccgatcagatcgattctggttctgccacaggtcggacaggacacgacctccacgccgcctttgcgcagccctaaggtacgcaggatcagcttcgcggacttgatctcctccaacgggtctcccgtgagcgatacgcggattgtatcgccgattccctgatgcagaatgagtcccagcccgatcgaggatttgatattgccgctgatgatggtgccggactccgtgatgccgacatgcagcggatgatccgtctgtgtcgcaatcagctcgtgtgccttcacgcacatcatcacatcggaggatttgatgctgatgaccagattgtcacaccccatatcctcgatcagatgtactttatcgagggcgctctcgacaatcccctcagccgtcacaccgtgatatttttccacaagatctttttccagagatccactgttgacgccgacacggatcggaataccgcgctcttttgcggcatccaccactgcgcgcacacgctctgtacttccgatatttcccggattgatgcggatcttatccgcaccgtgctcgatcgcggcaagcgccaggcggtaatcaaaatgaatatctgccacaacgggaatgctcacctgctttttgatctcggtcaatgcctccgccgcctccatggtcggcacggcgcagcggataatatcacatccggcagcggtaagcgcctgaatctgcgccacagttgcagccacgtcctccgtctttgtatttgtcatggactggatcaggatcggattgcctccgccgatcacccggtcgccaattttcactactttcgtcatctttttgcctttctatccgaacagcttgcggatatcattaaaaaatgtaaaaaacatgagtgcaaacaacagcatcatgccgataaaatgtaccatgccttccttgtcgggatcgacgcgctttccgcggatcacctcgacaatcaaaaacagcagtctgcctccgtccagcgccggaagcggcagcagattcatcacaccgaggtttgccgataagaagatcgtaatgtaaagcatctgcaaaaataccatatagtagccgtacgtcacgctctgctcatagctgtccccgatcatattcacgattccgaccggaccgctcatgtcattgacgctcacctttccgtccaccaaagactttaagctgtcaatcgtcacgcggatccagtattccacctcatatacgctgtattttaaattggaaagcacggaacctttcgtcttttgcgcgcttccctgaaagccgtacatataatagccgtattcttcgttatatttgggcgtgagcaccgtctgatagcgttctccgtcccgctcataggtcactgtgaccgcgtccccggaatgaaactgtgtgtaggcgctgatgtcccggaaaaaatgtatccgggtgtgatcaatctttaagattgtatctcccgcctgcattcccgcctcctcggccggatatccctccgtcactccggcgagcaccggcagatcatagccgatattgcataacagaataaaagcaaagacaaacgccatcaggaaattgaataccggaccggcggcaaccacactgatgcgcgcccagactgattttttcccgaacgccctgccgtcctcgctctccgtatcctctccctccatcatgcacgctccaccgatcgggaacagatgcagggagtatgtcgtctctccctttgtgatgccaaacactttcggtcccagcccgagacagaattcattcacccggattccgtttgccttcgccagaaggaaatgccccagttcatgaaaaataataatcagactgaatatcagaattgcgataataatcttcatgcaaaaacctttccccatttgcctgcaatgtgttcatatgcggctgcctccgtctccaggatctcatcaaccgtcggattggcaataaaatcagctgcctccatacacgattcaatcatctccgggatctgctgataggcaatttttcgatccaggaaaagcgctaccgccttttcattcgccgcattaaatgccgtcggaatattgccgccgcggcgcatcgcctgataggctaacgcaagaccgcggaacgtctccgtgtccggtctctcaaacgtcagctgtcccaatgcaaacagatccagtctgtcgcccgagagcggtctgcgcttcggataatagagcgcatactggatcggcagacgcatatccggtgtgccgagctgcgcaatgactgcgccgtcctcatactgcaccgcggagtggatcacactctgcggatggacaaccacctcaatctgctccagctccacatcaaacagccactttgcctccatgacttccaggcctttattgacaagcgttgacgaatcgatcgtgatcttgcgtcccattgtccagttcggatgacgcagcgcatcccccacctgaatgtgcgccagatcttccggctttttcccgcggaacggtccgccggacgccgtgagaagaatcttcgcaatgcggttcccgttttctccctgcagcgactggaaaatagcactgtgctcgctgtcgaccggcagaatcggcacgccgcatttttttgccagcggcataatgatatgacctgccgtcacaagcgtctccttgttcgcaagtgcaatctttttccccgcttcaatggctgcaatcgtcggtcttatgccgagcatcccgacaatcgccgtcacaaggatctcactctccggctgtaccgccacctccagaagtccatccatgccggacaccacgcggatattcagatccttcgtgcgatcgcgcagttctttggcggcgtccttctgaaaaacgcataccagcagcggatgaaactctctcatctgctcttccagctttttgatgttgcttccggccgcaatcgccgtcacctgtatgtcgccctgctcccgcacaatatctaacgtctgtgtcccaatggagcctgtcgatcccaaaatagctatcttcatcataggtctctcccaaaattacaatacaatcaaattagcggcaaggaaatagatgagcggcgccgtaaaaatgacgctgtcgaaacgatccaggataccgccgtgtcccggaatgagttttccataatccttgatgccgtaattacgcttgatggcggaagctgtcagatctcccaccatggataccagtgcgcccgccgcactgatggctgccataatccagacatgtgacatctcacttcccatcgccccgcgaaataccatgccgtaaatcacggtgagaagcgcagctccgatcacaccacccacggcgccctccacggactttttcggactcagcttcggcgtcatcttatgcttcccgatcagcatgccgacacagtacgcgcaggtgtcgcatccccaggaacacagaaaaataagccacacaatgtaggttccggcgctaagcattctggtctggtacacgtaggacaacatcactgccacatagaacacgccgaaaaatgcggcgagcagctgctccgtctgatacttcgggtaagtgaacacatacacgaacatcaatacgatcagaagccctaaaaccagcatcatcagatccggcagaaagccgaagcgcagattcgcatagtagaccgccgcagccgcatacccgacaatgcccggtgcagacttctcaatatgaaaaatccggtataattcaaacatcccgatccaggaaatcagcaacgtggacaccagcagcacatccccgccggtaataatcaataccaatgcggcaatcacaagaacgattccgctcaataatctcgtcttaaacatatctcctccatccggcagtccttcctatttcttgtctgtcaaaccgccaaatcttctgtctcttttattatacgcttcaatggcacgctctaattcctctttgtgaaaatccggccacggcacatcggtaaagtaaaattcactgtacgccagctgccagagcaggaaattggacaacctgagttccccgctcgtgcggattaaaagatccggatccggaatgcctgcggtatccagatactcctcaaacacactttccgtgatctcttccggctttctcttccccgccgcaacatcttcgctcatacggcgcattgcgcgtgtcatctcgtcgcggctgccgtaattgatggcaatctgaagattcaagccgtcattttttgcggaggcagcctccagttcacggatgcgctcctgaaagcgctcactgagtctcgtcgtatcgccgatcacgcgcacgcgcatattgtttttgtctgctgtcttaatgcagttcttcagatagctttccaaaagcttcatcagcgcttccacttcgccctccgggcggttccagttttccgtcgaaaatgcgtacatggtaacatactttacaccgagatcatgtgccgcctggcataccgtctcgacattcttggctcccgctgtgtgtccgtaattccggggcattccctttgcttttgcccatcttccgtttccatccagtatgatcgctatatgctgtggaatctttcttcccgtctccatacctgtgcttctccctcgtatctgtactgaagtatcaactatacaaaataacggaaaagatacagatgtatgcctccataaacacctgtatctcctctcgtttcaaatctatccaaactatacggtaaggatttcctttgtctttgcctcaacggcacgatccacatctgcgatgtacttatcggtcatcttctgtgcctgatcttccagctgcttgatctcatcctcggagacatcctccttggcaagctttttaaaggaatcattggcatcacggcggatattgcggattgcaaccttcgcattttcgccctttttctttacatcctttgcaagttccttacgtctctcctcggtaagctccgggaacagaagacggactgtctttccatcattcgtaggattgattccaagatcggaagtaaggatcgccttctcaatctcctttaccatggatgcctcccacggctgaatctgaatcatacgcggctccggaacactgacattcgccacctgctgaattgctgtcggagtaccgtagtaatccactctcaacttgtcaagcacatgcggattggcgcgtcccgcgcggattccgccgaactcctccgcaagattgttcattgttttgcccatcttttcatcaaataccgctaatctctgatccatatatataccatgcctttctatcaattctaagaaaccgtaaccttcgtgccgctaaactctcccgtcatggcttttacgatactattctcttcattcagtccgaatacatacatcggcatccggttctccatacacataatggaggctgtcagatccaccaccgcaagcttcttgtcaattacttcctgaatagagacttcatcatacttcactgcattcgaattcagcttcggatcactgtcatacacgccgtcaatcgcttttgcgaggtagattccgtccgcctccatctcaatcgcacgcagaacaattcccgtatctgtcgaaaagtatggatgacccgttccccctgcaaaaaacacaaccattccctttgcaaaatacttattcgcacgatccttggaaaacagctttgtcatgcttccacactcaaaaggtgtcagaatctgtgtctgcatgcccacagagcggaaaatctctgaaacatagatgcagttcatgatcgttgcaagcatgccgatctgatccgctttggtgcggtcgatcgtctcgctggtgcgtcctctccagaagttgccgccgccgatcacgatgcctacttcggtaccaccatccacaatctgctttacctgttttgcaacctctgtgactgtcggctcgtcaaatcctgtgtgtttatcacctgcaagcgcctcaccacttaactttaacagaactctcttcatgatgcttagtttcctttcttggcattgaacaggctctgaacatccacatctgcatagcactgggagcagaatccctcaataacagcgccgttgttgatctgaacagaacgggacttgatgttacccataaccactgcggaagtatccacaacaaccggtccctgcacatcgatgtcacccttgatggctcctgcgatcactgccgagttggatgttacattacctataattacagaaccaagaccaatcttaaccgtaccggagcttacgacttcaccctctacctgtgcagaatccgcgaagaattcggaagtgttgctgttaccattgacaacacctgtcacggtaagctttccgttgcagcttacatttccgtctacctgacctctgatgtcgagagatccgtttgagatcacatcaccattgataatcgttccctctgtaatcacggaaacctcgtccgatacaatcggcttctcctgcggtgtggtctgcgatgctgctgcctgtgctcctgtctgtgctacctgtactggtgttactgtattatcagccattttcttctcctcctgtgctgctgccattgcatgctgtgtgtattcttctcttgttttctgtggttccaccgttgctgcctgtgtccgctccaaagccggctcctgcttcgttacctgctctaacagaccatccagcttcgacaattcgctcgccacatccacttcatcttccagtgtgttcacgaccatgtcatcatccttgtccgtgctttcgagattgtcttctcccggcataagttcattcactgcctgtgagaaatcatccttaaagtccttgaaaaatcccatgttcttacctccatttataatctggtcatctggcactgtcggctttgacatactggataacctgtgtatcttcatcaatcggtaaaatctcggcatccatatcctgcaatgcctcgatcagcggtcctaccgcttctaccgttgttgacttatcttccgagtcgtgcaaaagcacaaccgaggtcttgtattttgaaacatctgaaacaacattctcgaccagttcttccgatgtatatgcagcatttgccgcatcgcctgccgagatgttccagtcgtaataaacgacgtcctcgctgtttaaaaaccggatcagcgaactcatcggcacattgctgatctgattgctgctcccgcccgggaaccggtaatagcggctcttttcaccggtcacctcatagagataatcctgcagctgatgaaaatccgcctcaaacgcatcctccgactgatagatcagactgtacttattagaataggaatgcattcccagcgtatgcccctcatccacgatcctctggtagatggctgccgatgcctcatcctcttttccgaccacaaaaaaggttgccttgacatcgtactccgacagcacatctaaaatggcgtccgtattctcagacggcccgtcatcaaacgtcagataaactttatgtacatctccatcctgtgccagattgtctgtctcgtcgatcccggatgcaggtgccgtcacagccactgtctccgtatccatgccgccggtctcttcctggggtagtgcctccgtatccggcacctgctggttcatcacccgctgcatctgccagagttcatctaactttctctccatggatctcgtccggacaagcagaaaaatgatcagaatcatggacaggatgatccacccggcaattatcgcgattatggtatgtttcattcttgcaatccgctttctccgcctgcgttgattgcggagtgcctcagaatccttatcctgcatgtagaacccccaagttaatcataatactttatctattgtatcacatttttgtatttttcaaagaaaaaagcgcaaaaaaatcgtatgatttttctacactttttcatgtattttctgaatttttatgtttctccagctaaaagcccggtgaccaccgcccccacactaaacagcatcacgccccaggcgatgacagccggcgatgtcccgcgcagcgggattttccctaatatggcaaccggggacgccgccagcagcccgaaaattgcccagtaggtcagcctctcaaaccggcagagcagatattccatcagctttgcgacaagaaaaatacctccaagcacgccgcatccgaacgggactaatagggcaagacagtaccacgccgtcccggcatccagcatgaccaccgccacaacgaacgcattgatatggtcaatgaccggcgtgtaatatccgagcgccatcaaaagcatcgaaccgctcacccccggaatgaccatcgtagccgcggcagccagccccaccgcaaaaagcttcactgccgtcccaggaccggcggcaagaacctgttcgctgccttttccaaggaactgcattccaatcatcaggcagaagaatcccaaaaacagcgccagctccggcaccttcggatatcccctggacaccttgcgccagatgagcggcacgccgccgaaaatcagtccgataaaaagcatcgcggtctggaacggaaaattctcaaaaagataaccgatcataaaggaaaggcagataattccgatccccattccaaacagatacggaaacagctttaagatgctttcctttttatgacggaaaaatccggtgaccgcctgcagaagttcatcataaatccccagcgacaccatgatcgtaccgccgctcactcctggaactacattggcgattccgatcgtaattcctcttatgacattctttatgaattccatacatcctccacttttttgcatgctgcctttctctgttccgccgcaagcgattcgctcttcttatccggaagaagatgctctgccatccctgccagcagatttccggccggaagcaaaagcagggtcgttccgatattaaaaatcgtatgcatgttggcaatctgggcagccggccgtcccggcgtcagctgcgcaaccagcgaaacgagcggcgttgtcatgcacagcacggtaaacaccaccgttccgatcagattgaacgaaagatgaatgatcgtggtgcgcttggcgtttcttccggtgccgatggcagcaagaaccgccgtaatgcatgtgccgatattctgaccgaacagaacatacaccgcccccgcgaaagatacggctcctccctgtgccagggtctgcaaaatcccgaccgaagccgaggatgactgaatggctgccgtgaacgccgcgcccgccaggattccaagcagtggatgttcaaaccttgtcatcgcccgaaggaacacctgcgaatcacagagcggctgcatggcttcccccatcatatccatgccgataaacaggattccaagccccgccacaatctcgcctgtgtaccggatccggtcttttcccgcaaacagaatcaggaccaccccccaaaaagccagaagcggcgcaacggctcccgcatccagtgcaatcagctgaccggtgattgtggtgccgatattcgcccccatgataatccagaccgcctggcgcagagtcatcatcccggaattcacaaagccaacgaccatgaccgtggtggccgaggacgactggatcactgccgtcacagctgctccgacgcccacgccaaggaagcggttctttgtcagccgctccaggatctgcttcatcttctcacctgcggcagcatttaagccctcgctcatctgatgcattccatacaaaaagagtgcaagccctcccagcagtgcaaaaaaatttctatattccattttcttcttttcccttttcttatcctaatcttatgacgcttctaatacctgtgataaccaaaagggcaaatcttttttaccgtcggaattgtgcacgaatcgtaccatgcggtaacctgccaggcagatgcacgccgccgtgacggtaagcactaccgcctctgcatagggaatctctgctattttgaataaaacagcagtaaaaagatgaaaaaaaagacgctgctccgccgccccggtcatttttctcgtcacgacaatcatactctgtgacaatcctgcttccggttccgccgagagcgcgtttgagacataatcggagtccgtcgtccgtaaaataccctgtgcttcccctccggcctctgccgtcagattctgcacctgggcgatctgtgtctgccacagacagacaccaagatgggaaaacagcagaaccgccatcatgcaaaccgcaaaaaatgcttttcttctatctgcactgcgcatgttccctgctcctttcccattccaagactctttcctcacgatagcaaagcacttacgacttgtcaatagatgcggatatattttccataaacctgcgcagtgtctgttccgttgtcgcaatcgcttcctccggaatgccttcggccagcctgcggaaaaacgcggcttttttctccgttatctgcttcgtgagcacactacattgctgcgtgagatataaatggcagattctcttatcggcagcatcccgttccaccacaagaaactgcttttccacgaggctctccaccgatctggcaaccagtcccttggacaccccctcgtactgcgcaatatcccgcgccgtattgcatccgccgttgtcgcgtgccaaaaaaagaagcaccagcaattcgttcggcgtgagatgatatttctccatctcatcctgaaagtatttccggtatgctttctctatcttaaaataattttcaaaaaagtcctccagcatgttccccctcctttccgccggttcatgccttctctttgttttagttgatttgtgaactgtttatatagaaactttatttgaaatctgtataaaagtcaattaaaaaagtgttaaaatttcagaaaaatcactccgactcggttgactttctacacaacaaccgataaaataatagttgatttgtgaactgtttaactggtaactctattaaccgaatcctagaaagtgtgtgatgttattttgaacaaaaaattaaaagagaaattcgacgaatctgtaagcgccgttcttcccattaccgtcattgtgctgttgctcagcatttttgtcgtaccgatggagaccggaaccattgccctgtttctggtcggagcgttcatgctgatcatcggcatggcatttttccagctgggtgctgagatggcgatgacaccgctcggcgaaggtgtcggttcccatatcatgaagacgaagcgtctttcgattctgattattgtctgctttgtgatgggtgtcatcatcacaatcgcggaaccggatctgcaggttctcgccaatcaggttccttctattccaaacgaaaccttaatctggacggtcgctctcggcgtcggtgtctttctggtcatcgctgttttgcgtatcattttcaagctgagcctccccctgctgctgtgtatcctctatgccgcactatttttgctctcctttgcggcgccggctgatttcatcgcagtcgcatttgactccggcggtgtgacgacaggtccgatgactgttccttttattatggccatcggtgttggtctctcctccacgcgaagtgacaaggacggttcgagcgacagtttcggtctgatctccttctgcagcatcggaccgattgccatggtactcctgctcggtattttctaccatccagccggtgcatcctacaatgccaccgaaataccggatgttgtgaccatgcaggatgtcatgcgtcagtttgtacatatgctgccgggctatggcagggaagtcatttcttccatccttccggtactgatcgtctttttactgtttcagctcatttccaggcgctaccacaagaaccagatgatcaagatgcttatgggctttctctacaccatcatcggactgatcctgtttctgaccggtgtcaacgtaggatttgctcccgtcggaagtctgctcggcagcaatctcgccgcacagacatggcgctttgttctgattcccatcggcgcgttaatcggttattatattgtaaaagccgagcctgccgtgcaggtgctcaacaagcaggtggaggatgtgacaaacggttccatttcgcgcagtgcgatgaacctctgtctctccatcggtgtctccgcttccgttgcgctggcgctgctccgggttctgaccggacttaacatttactggctcttaattccgggctacatcattgctctggtgctcacccggtttgttccaaaagtatttgtcggtatcgctttcgactccggcggtgttgccagcggtcccatgacctccacgtttcttcttccgcttgccatgggcgcatgtaccgccgtgggcggcaatgtggtaaccgatgcgttcggcgtcgtggcgatggtcgcaatggcaccgttaattgccattcagatcatgggcgtactgtatcagctgaagcttaagagggcgacatccgatgcgcttatcatgatcgatgtcgacgacaatgccattatggatattgaggaggaataattatgcaggatcataccatgcaacataaaaaaaagatgccggcattccggtgcctcgtcattatcatagattccaatatccgtgataaactgaccgaatttctcaccgatgcctccatcccgatctattaccagatgcacggcgtcggcaccgtcagttccgattttctgaatctgtgcggtctcggcgacaccaacaaaaccatcatgctatgcatcgtcccgaaggaacgcacccgtatgctgttggcggagatgaatcaggcgctgcagcttcacaagagaggaaccggtatcgctgtcagcataccgttatccggcattcagggatggctctataaagttctcggttccggttctttggactcctctgagccggagatagaaaaagaggtgaaaaaaatgagtgaaacgattacacatgcaatgattcttgtcacaatcaatcagggatacagcgatgatgtcatgtacaccgcgcgcgctgccggcgctaccggcggaacgatcttaaagggtctgcgctgcagtccggaggaggttgccaaacatttcggcatggctctccaggaggaacaggaagtccttgccatcgtcgttccaaaggataaaaagaccgaaatcatgaccgccatcagcaagcagcacggcattgacacaccggcgcacggcgtcagctttgccctgccggtcgacgcgatcatgggactgtagaatttatactttatgacgcaaaaaccttatcgaatcataaccaggttcgataaggttttttcttacaaaatgacccctgcaaatagtgtctccaccattcgtaggggtcattatccttcaacaatttagcacaatatcaaattatgcgttcatctgtgctgcaacttctgctgcaaagtcttcctgcttcttctcaagaccttcgccagtctcaaaacgaacaaatctcttaaccttcacagtaccgccaactgccttggatacttcctcaagatacttggcaacggtctgcttgccgtcctcagccttaacgtaaacctgatctaccaggcatacttccttgagttctttgctgatacgtccttcgatcattccgttgattaccttctccggcttctgggactccttcggatcgttcatgatctgtgctaagaggatctctttctcatgagcgatgtaatcagcacttacctcgtctctggaaacatacttcggattgagtgctgcgatctgcattgcgatattgtgcattgcttcctttacagtgtcatttacaacatcggtgtctgcatcaacgataacgccgattcttccgccgccgtgtacatacggtacaacacagccatgctcagctacaaccttctcaaatctgcggatctttaagttctcgccgatcactgcaaccttctcaaccagtgcttcacttacggtcttgctggcatcctcattccacttctcagccatgaaagcatccatgtctgctgcatcggaattcactgcctgtgttgcaacagccttaacaaactcctggaatgttgcattctttgcaacgaagtctgtctcagagtttacctcaacaaccgctgctgtctggtcatccttggtcactaccatgcaaagaccctctgctgcgattctgcttgccttcttctcagccttagcctgtccgttctttcttaagaactctacagcctcgtccatgttaccgtttgtctcatttaatgccttcttgcaatccatcatgcctgcgccggtcatctcacgcagttcctttaccatagctgctgtaattgccattttctcatcctccaaaaaataatttatcctgattctttatctttatgccacagaaagggacgtaacacgcgtccctttccgattgttgacatatgggcgatcctgccaatcaggcacccgttgtttccaacttattatgcttcctctgctgcatctgcctctgcggactcagcctcttctgcagtcatctctgcaccctggtttgcctcgatcactgcgtctgccatcttggaaacgatcagttttacggctctgatagcatcatcattgcccgggatcacataatcaagttcctcaggatcacagtttgtatctgcaataccgatcagggtaattcctaatgtatgagcctcctgaatacagattctctccttcttcgggtctacaacgaagattgcatccgggagcttcttcatctccttgataccgccaaggttcttctctaacttctcccactctttcttaagtgcgataacttccttcttcggcagtacctcgaatgtaccgtcggttgccattgtctcgatctcttttaatcttgcaatacggctctggatggtcttgaagttggtaagcataccacctaaccatctctcatttacatagaacatgccgcagcgctctgcttcggtcttgattgcatcctgtgcctgcttcttggtacctacgaaaagaatggtgccgccctcagctgcaatatcagatactgctttgtaagcctcgtctaccttgcctacagatttctgtaagtcgatgatgtagataccatttctctctgtgtagatgtacggagccattttaggattccatcttctggtctgatgtccgaagtgaacacctgcttcaagtaactgtttcattgaaataacgctcattttcttacctccatggttgaaatcttccatatgcttcatcccgcaaggcaaccattcggcaccggcccggtggtcagcatatgtgtattattgtgtggaaatgattttccacgcttgaacctcgcatattatatcacaaacatctttgctgtgcaagtacctttttactcttcaagcggtcccgcctgcagaatttttgcaatttcctcattcgacagaccgtaaggaatatcgtagttgccgacacgcatattggaagcgtagccgatctgcgataaatactgccggaacgtctccgcatcggaaatgactccgttctccgccagcttctcgcagacaatacggcagacatcccctttctgaatcaccagacggtatacgccggacggattctctgcatcagcagcctcctgctgtgcctgcgtctcctcatccgtgttcgcgctattctcctgcgcctcagctgccacgtcctcagctgcagcttccgtattctgcgcggtctcttctgccgcggtccgttcttccaacagttcggatgccgtctgctcggtcacaacctccgtcttcgctccggtgtccgtgccgtccggatcctgctccgtatcgccctgctctgttgtctctgtctcctgcatgaccatgccaagctgtgccgcccgcgccatgatctcctcatcagacatcttgatctctttctttgaaaaactgactgccagtatcaccgttgtgacaatgattccgatccccagtccccgcaaataatatttcagtttcacgaatcactctctcctctgtaaagcccattgaccaggcgaacttcaccgattccgattccaagcttcttggcaatctgaacctccgtcattccgagttttttcaacttcagaatctctgcatgcagtccttcctgctttgtctcttccgtctccggcatctcttccttctgctctgccggtgcagcagccgtatctctctccgtcgtatctgccgtctcaaccggtaccggtgttactgccgagaccgcagataccgctgcggcacgctccggtgcagcctgcggtgcagtcaaaggtgctttctcctcaaggcttcttacatccgcagccaggcgctgcagatccgccgccataccggtaagctccgtgtgtttatcgttcagcatactgtataagaacataatctcattatgcgttttattcatgctctcgatcaccgtgtcggaatattcactgatcgccatgatcttatcgtttgtcactttttcaagggaacgatccaccttttcggaagactggtcaacctgctcatcaatcgcatcctcaatccgtgtctccgcattcttgagtccccggtcaatgattctctttaattcctcttcgctcaactctgcaatctggttcaattctgacggcgataacttttccgtcacaaaaaagcttccgatcataaaaaccacaccgatcagaagtaatatccatgctactccggtcatatgcttctcctcacctatctatatcttgatatcaaaatggctgccctgcccttttaatatgacttttccctcattctcaggctcctcttcgcggcgctttttgtgcctgccagattcgccctcatattcgttattgcccttttccttggcatcataacgatagccatcgttctccttttcctccggatcctgcacacgatgggtcagctggtcttcgtgcttctgctgttcaatctgaatattctgctgttcgacaatcggcctattatcctcctgctgcttcagattcccgacatcctgcgtcctctgaatcatcccgtttaaaacaactggtcttattgacatgcaacacacctccgctcatctgctactcagtcagaattcccatatagcttcccatctttttgcgcatcttaagcagcgcctttgtgtgaagctgcgacacacgcgattcagacacttccaatatattgctgatctcctttaacgtgagttcttcataataatacagaagaatcaccttgcgctctttttccgtgagcagatccattgtctcggacagaacttttttcagttcttcctcctcaatattgtcctccggctgtgcgaaatgggagttcccgcgcgcatccatcaccggctctccgccctgctccacgaactcattgagagataccacgtttgtgacttttaactgcgactgccactcattcagttcagccgccgcaattccaatctcccctgcaatctcttcatccgccgcagcacgtcccgtccgcgcctcgatatttttgattgcttcctcaatccgcttctgcttctgtctgacagtccttggtatccagtccatcttgcggatctgatccagaatggaaccgcggatacgcaggctcgcatatgtctcaaactttacgtcttttccgggatcaaacttatcaatggcatcgataagtccgaatattccataactaaccagatcttcgtattccacattgtatccaagatacatgctgagccggcccgcaaccactttcacaagcggtgcatattccgtaatcagcttttctctcagcgcagacgatggatttttctggtattctccccatagtttttctctgtcaaccgttttcattggaagcccccacgtctaaagattactgttctttcgcatcggcattctctgtctcctccgatgccgtttcattctcttctgcctcaggatcctcttcttcctgcggcaatgtaccatccgtggtttcctcgtcattcatcccggcaaaattgcggtcaagaacaattttgaccacaccgcccagaaggtaaaatacaatcaggacaatcaaaagcattttcatgaaatctgccacttccatgtgtgcacagatgcccgctacgcaggcgacaaacccggctgacagcatcacaatcgcaggtactgattttgttttcatacttacagcccttccttaaataatcttaagcggcttgcccaccgacttaatataaaattctccggtatcacaatgcagttccactgttctaccataattgagtcctgtatcttccgctaccagccggattccaagttcttttaaaatcgctttggcagcctccgcattcctcgctccgatatttcccacatccgaaagtccgcttacctcaaacatccgcgcgcccccggcaatcttggcgatcagtcttggcttacttgctcccgctgcaacaacacgctttaacaattcccgaattcccgtatctccaaacttagctatattgctgttgtttcttacttttgtactgtcaggaagcatataatgcaccatgcctcccacttttgtcaccggatcataaagaaccagtccaatacaggaaccgagacctaaagtcgtaattacatccggagccttgcaaacgttcaggtccgccatgcctacttttatgacttcgctcatatacgcattctccttatattgagataccaagtgacgttaatattttttcgtaagaatcctgctccggcatcaagatgaaatatccgttgatcgccacatccgcacagatctccgtctgtatcaacaatgcattgtcaccgtactgtccaaattcaatcgccggcacgctcaaaatcgatgctgccatgtccaccgcgatgtatggaacggacggagtgatgacaagattggtcagggaggacaatgcggacagataagatcccgcaatgatattgccgatctcttttaatgcggaaagttccatctcgccaaacggctggtcatccggttcgtttgtcatcatcagcttgttgaccagataacgtgcagacggaatatccagaaggaacatcatgcttccctcaatatctgtctccacctcaaggaaaatgccgacaattgtctcatcttccgctcctaccgccattcccaactgtgatacttccatcagccggatgctcggtacattcatatcgatcttcatgccaagcatatttgcaatggctgaagtggcatttcctgctccgatattgccgatttcacgcaatacgtccaggtacatgtcattcacttgctctagtgtcatattacccatgaacgttttttctcctctcaacataatatatccatggttttctaagaggaatgtctctggttctctcccgctgcattccctgtagtaaaacaagcaggttagcggaatgtattccattccgctaacctgcgcacacgtctatgcacgcatatgttctgtgtgcttatgcgttgtcatccaccaccgagttaatctcgagaagtgagatcagatcatcgccgtgtttaccgattccattgatgaatttacccttgttggtcgatttttcaatttcatcctcacttaaattgacgacttccttcacctcgtcgacaatcacgccgatcgcgcctttttcttccagctttaagatgatgatacggctcgcgttcgtgaacacatcatcctccagccccatcttgttgcggatactcattacggatacgatctcaccgcgcagattgatcacgcccttaaagtaggactggatcttcgggacacgggtaatcttctgcatacgcacgatgttgtcaatatagctgatatcaattccgtactgctcgcttccgaccattacgacaatatactgttttgactctttgtcaattacttccacgttcttttctgccatgttgtccgcctcctcttacatcagtacattcacatcaaggatcagtgccacttcaccatcgccaaggatcgttgcgccgctgatgatcttgttgttgtttatgtatttaccaagtgacttgataacgatttcctgctgtccgatcaggttgtcgaccacaaggcctgccagattctcgcccttctgtacaatcacaaccgtcaggctctccggctcttcttctttcggctcaatatccagaacctgatccatacggatcagcggaattaccttgccgcggaggtgaatcacttcctgagcctccacatacttgatatccttcaccggaatatcctcgatgttggaaatggaaccaagtgcgattgcgtatttctcatcgcggatctctaccatgagtgcctggatgattgcaagtgtcagcggcaggcgtacggtaaaggtcgttcccacaccgagctctgtctttacttccacatcgccgccgagagcctcgatgttggattttacaacgtcaagtcctacgccacgtccggaaatatcggtaatcttcttcgccatggaaaagctcggcagaaacagcagattgatgatctctttctggctcattgtctcagcctgctcctcagtgatgacaccgcgctcgattgccttgttgcgcacagcctccacatcgattccgttaccgtcatcgccaacctggatgatgacattgttgccttcctggaatgcgttgaggaaaatgcttccgacttccggcttgccctttgcaatacgggttgcgttgtcttcaagtccgtgatccgcggaattacgaagcagatgctgcagcgggtcaccgatctgatcgactacggtacggtcaagttctgtatcttcacctgtcatgtacaattccatcttcttgtccagctttctggaaagatcacggatcatacgcgggaattttgcaactacactctcgattggcaccatccggactttcatcacggactcatgaagattggtcgtgatacgctccagatattcaatctgctcatggaaggactggttctggaaatctccggaatcggtggagctgatcgacaccagactgttctttgcgatgataagctcggatacctggttcatcaatgcatccagcttctcaatatctacacggacagtacggtttgtgactggctttgcaaccgtctgctttttattgccgctgctctgtgtcttcgctgccggctttgctgcctgtgcctgtggctgctcctgtgccggtgccgcctcagccggtgcatcctgagacttctctgccgccgcagcgtccgcttccgctttctcctgctttgcagccagcgtctcgtattttacttcctcaccgacaaccttatcaatctcagacaccgactttgcagcttccgcaatcttctcatacggctcgtccgacgcaataaaaatgctgaaatcgcagtcgaacttctcatcctcaatatcctgggagctcggattgtatacaaggatctctccaaactcttccactgccttgaataccaggaatgctctcgctgcctttaacaggcactccttctggatatagatggtcatgccgtaaatgtgtgcgccgccctcttccgcctgcttgattttatccttctcggactcgctgagaccgaactcaaaatactttttatcatctccgcccgcggtctgtgccggtgcctcttcttttttcggctccgactgtgcaggtgcagctgctgcgccatcctccgccgcgatgaaatcattcagttccttgatgatcagttcgttgtcctctgttccctcatccgaacttgcctttacgttgtcgagatagccctcgatcgcatccaggcacttgaacagaaggtcaatcatagaactggtcactttgactttctcactgcggacctcctggaacacattctccatgtcatgtgtcaggcgctgcattctcttaaagcccatggttccagccattccctttaaggagtgtgctgcacggaaaatctcgttgatcgtgtccatgttctccggatctttttccagctccatgatgcagtcacttaaattctgtaaatgttcacttgtctcatcaataaaaatctcaaggtattggcttacatccatattactttacccccacattcttaataattgatttagctacgtcattaagaggaaccacttcatccacaacgcccgcctcggcaaccgccttcggcattccgtataccacgcacgatgcggcgtcctgtgcgatcacatagaccggcttcttcctggcaagggaaacaatccccttggtgccgtccgcacccattccggtgagaaccacgcatacaacctgatcgtaaccgcagtcccgcagggaatcgtacgtgatgttggcacacggcttcaagccgccgatcgcaggcatatcgttcaaccggatcctgtgacttccatccggctggcgcttcacttccatgtgcttgccgcccggtgcgatgtacaccgttcctttcatcagcacatctccgtcttccgcctccttgacatgaatcgggctgacctcgtccagtctgtctgccattgacttggtaaatccggcaggcatatgctgaaccagtaccatcggtgcgtccagattcttcggcagatacggaatgacactctgcagcgccttcggaccgcccgtcgaacatgcaagcgcaacgatcttgctgccactcttgatcgcatgtccggctgttgcaaccggctttgcggtccccgcaggagccgatacagccttggtctgcggtgtgatgcgccgttcacgattgtaactctgggtcgcgcataccgccgagagcacgccgagaagctgttttttgaactcctcgccctttgcctcaataacattggttggcttcgtgacaaaatcgactgccccgcgctccatcgcccggatcgtgacatccgcatccttggttgtcgtcgtacttaccatgatgaccgttgcacggattctgtccttctgtaactgttccaaaagctgcagtccgtccatgcggggcatattgacatcgagaacaacgccatcatagcgcgtcgtcttaagcttctcatatgcctcaagaccgtcacagcaagtatctgtgacctgaaatgttccgtctgaattgattatatcacacatgacccttctcatgagtgcagagtcatcaacaattaaaatctttttactcatatcttatgctctacccctttgacgcgctttgcgttcttcttcaaagatgaaccggatgatttcctcccttacactgctgtcggtaatcaggaatttggctctggcctcgtagggcgtttccggcgttttttctgtcttgatacaggaaataattgttccaatgatataatattgtttgtctaaattttcattctgcagatgtatctcaaagagaacatactgattctcccgaagcttctgatccgtccgaaaccggataccgccgccgcttagatccacgatccttccggcatattcccggtctctgctctttccctccgcttcctgcagttcaataaatagggcttctcccgtctttaatgcggcttcctgttcctcaatggtgtaataattcatgtccataatacatggaaaccggaagaattctcttctctgatacttggagatctgggattttaattcgatctctaacatgtatacattctctcttttgtagcgctcccgcacctggccgacggcgcggtaaagcgttcccttcgagaaaaagataaactccatccggatgcccagcggaagcagcaccagttttcctctctccaccggcatggaaatctcaagattgccgttctcctttaaatccagcacctggcttttgtagattttcggcatggactggtctttttttgcccgttccacattctgtacgaaactgatgtcaactttatctcccggttgaataatttcagctattgtcatcattccactccttcattcttctgtttccaaaatcccgaaaacaatcttgacagtccaaaagaacgatatgcgtcactgctctcaccctgcagcaattccgcagccactacttcaaatgctcttgcagattttgacaacggtgcctgaagcgatactggtttctgcatccggatcgccttttcaagcgcgctatcctggggaatcatccccgcatatgtaatttccccctctaagaactgacctaccacagtattcagtttgtcataaactcctctgccttccgcagcagatatcacacggttggaaagaaccgatatcttggtgtactccctgtcaaacttcggattccggtacagagactttaacagagaataagaatctgtcagtgatgtcggctccggtgttgtgaccacaagaacctccgggcttgccagcacgaactccagtacatgattggcaatccccgcgccggtgtccaccagaatcacatctgccatctgatccagttccccgaaacagtgaagcagataagagatctgttcatcggtcagattgcccagtccggtaactccggttccccccgagacaaacccgattcccatcggaccttccgatatgatctccgtgatctgttttccatgatatatcacatctgccagattgtacttgggaatggcgccaaacattacttcgacattggcaaggccaaaatccgcatcaaaaacaagcaccctttttcccatcttctgcatctgcaccgcaaggttcacagccacattcgactttccaacgccaccttttccacttgtgacggtaatgactctggcatccggcttataattttgtttttttaatttcacaacacttctaagcttctctgcctgatccatgtgttatctgcctcccagcagctgtttcacaatcttttgtgtatcaaatacttcaatatcatctggtacattctgaccgctcgtcatataggataactttgcccccgaatacagcttgatatttaaaatattaccataagtaattgtctcatccagctttgtaaaaatcaacttataatttgctatttccttgtaagtatctgcgatctccagcagatccttatatttggtcgtcgcactgagcacgaggtatacctctttctcgtaagcctcatccagtccgtcgatcagctttttcatatcctggcactgtgcctcattgcggtgcgagaatcccgccgtgtcaacaaataccagatcatattcgctcacgcgcgcaatggcatcgttcatctcctccggcgtatagataatgctcatcggagcatccagaatatttgcgtagatgcgcagctgctctgtcgcggcaatccggtaggtgtccgcagtcagaaatgccactttcttctctttgtctaccttatagcgtgacgcaatcttggcaagcgttgttgtctttcccacgccggtcggtccgatgaaaaaaatcaccttcggctttttgcctgtaagctcaatcgtctgcggctgatcgaactttaagatcagcttctgataaacgttggaaagaatagaatccacactgcttccgttgtgaagcaccttctccgcctcgtccatgatctgattgacatacttctcattcacatcattctccagcagcgtgcggtagagcatcttgataaactggaacccttccgtgcggttctccttttcctgcggctctaccggatgagacttgcgcatctcctccacggaaaactgcttttccagaatattcgacaggttctccagccgcttttccagtccctcattcgtagattcgcgctttgcttctttcataggaacaacctcctgttccgccggtgccggtgccactgccggtctggtgttctctcttgccacccccggaatggtaatcttttcatctgcagccagactgatcgtatcgtgcacaggctttgtctcgctgcggagcgtctgcgccgggaacgcttccttttcctccaccgcagccgtcacctcatacagcgtgttcttaaacatcttaaacatgcccttgggcttaatctccttcacgttcagcacgaccgcccccgcgcccagctcctgctttgccttctcgacggcctcttcctttgtcttgccctgatatttgttaatggtcatttatattgtcaccatccctactgattgtaattctacgttggattccacctcattgtaagacagcaccgtcagatccttgaagtaatcctcggtcagcttcttaaagtacatacgcacaatcggcgatgtcataatgatggcaggcttgcccatgttctccaacttcgccacttcctcctcaacggatgccataatcgccttcgtgcgctccggatcgagcgtcagatatgccccctgctccgtctgcttgacagaacccatgatctcctgctcgatcttcggatctaccgtgatcacgctggttgtctcattcgccgggaaatatttgctggagatcgcgcgctttaagctctggcgtgcgtactccgtcaacacatcggtatccctagtcgccggcgcatggtctgccagcgtctcaaaaattgtgagcagatctcggatggaaattccctccgagagcagattctgcagaaccttctggatctcgccaagtccaagaagcttcggcaccagttcatccacgagaaccggattgctctccttgaggttattgacaaggttctgtacatcctgtctggtaagcagctctgcgatatgggaacggatcacctcggtcagatgcgtcgcaatgattgacggcggatccaccaccgtatagccaaggctctccgcacgctctctctggctctccgtgatccagattgccggcaggtggaaggacggttcaaacgtcggaattcccgtaatctcctcctccacatatcccggattcatcgccatatagtgatcgaacaggatctctccctcggtcacctgaattcctttgatcttgataatgtactggttcggattcagctgaatgttatcacgcagtcggataatcggcacaaccgtaccaagttccagtgcaatctgtcttcgtatcataaccacgcggtctaagagatctccgccctggttcacatccgcaagcggaataataccgtagccgaattccagctcgatcgggtccacctgaagcagcgacacaacgttctccggcttgcggatctcctccgcctccgtctctgcctggctgacttcctcctcgatattctcaatgccgatgttcttgtccaccattctgcccgctacgataaacgcagcgcccagcgcagcaaacaataccacattcagcggtgtcacagcaccgaggaagatcaacgatccaccgaccagataaagtgccttcggaataccgaacagctgttttaccagaatgttggagaagtctgcattcttggatgccttcgtgacaaggataccggtagaaagtgagatcagcagggacgggatctgggaacagagtccgtcacccatggtgagaagaccatagcgctgaatcgcctccgaaaaatcaagtccaccgcgcatcatccccatcgcggttccaccgattaaattgacaaacgtgataatcagtccggctgtggcatctcccttgacatacttcgtagcaccatccatcgaaccgaagaagcttgcttcttcctgaatcttattacgccgctctctcgcctgtgtctccgtaatggctccggtgtttaagtcagcatcgattgccatctgcttaccgggcatagcatccagtgtaaatcgtgcggatacctctgccactcgctcggaacctttattgataacgacgaactgtatgatgatcaaaatgataaatacgaccgctccgacgatcatatcaccaccgcccacgaagcttccgaatgtttcaacgacgttacccggagcaccggtcgttaagatcagacgtgtcgaggacacgttaagagaaatacggaatatggtagtaaacaacagcaatgtcgggaaaaaagacatatccagaacttccttcacaaacaatgtgttgaacagaacaatcagtgcgatcgagatattcagcgccagcattacatcaagtaacgtagagttaatcggcacaattaaaaagatgactgcagcaagcaaataaagcgcaacacctatgtcagcctttttcatatctcttcctccttcgttttactgtctcatattatataccattgcaagaatctccgctactgcctgatacaattccggcggaatttcattgccgatttcgacattggcgtagagcattcttgcaagcggtttgttttctacaatttcaatgtgattctccctggcagcttcacggatcttctgcgccagataatcttcaccctttgccagaaccaccggtgccttatgcacctccggttcgtacttgatggcaaccgccagatgggtcgggttggtgataaccacatccgctttcgggacatcctgcatcatacggcgcctcgatgcctcgcgcatacgctggcgctgtctgccttttacttccggatttccctctgtatttttgtactcgtccttgacctcctgtttggtcatcttcatctcttcattaaagcggtatttctgatagatgaaatcagcaattccgacaacgagatacaccagactgatcttgagccctgcaccgataatcacatctccacacagtgcgatcgcctgatttaacggaatatcatataaaataaaaaggtcattttcgtgatccttgattgcagtatacgcgatatagagaatcagtgcaatcttaatcagggatttgaacagttcaaaaacggaatccttggagataatccgcttcattccgttcaccggattaaaccggtccagctttggctgcatcggtttcgtggaaaccttccaccccacctgcagaatatttacaagtagcgtcacggcgaatccgaaaataaaaaacggtgccacgattttgagcatctgtatattcaccggtgaaaagaaagacattaccgcataggtggacacatccatcgcattgattccgataaaatccggaatcagattatatacatagtaaaatatctgaagaaatccgtcgccaatcgtggagacaaaaatcttcagcatcagaaacatcacaatcagatcaaaggcggcggtaagctccttgcttttggcgaccttaccgtcctctctggcttctcttaactttttcgcggttgccggttccgtcttttctccgcccggtccatccttcgcaaaccactggaggtgatagggaaggatctgtcttctgtcctgttccaagctaatacattccctctatcatcgatacaatcattcgtttcatttctttaaacacaaaatcggaaattcccggaagcagcattaccgtgaggaacaataccgtaagtcccaggagcaccttcatctgcattccgaccgcaaacatattcatctgcggcgctaccttcgccataatgccgaggatgcagtttagtatcatcatgcaggcaaataccggcagcacaatgcggaacgcgatcacaaaagaatccgccatataggttgtcatggactctgccaggctgtcccattgaaacacctgcccgttgacggggattacctgataggaatcaatgagcgcccgcagtacataatgatgcatgttcgtcacgaccatcatcagaagcagcaggtactgatacagatttcccgtgatggtgacctgcgagttggtcatcggatcgaactcctgcgccatggaaagtccgatatccatgtcaatgatatttcccgcaaataaaataatggaattacaaatgtttgcagcaaatcccatgagcaaccctgtaattccttctcttagaacaatcaccgcatatccaaacatgcccgtgtaggtaaccgctgactgatcgaccgaagggaatatcaggatcgacaaaagaaacgataatccgatcttcactctggacggaacatttttcatgccgaaaaacggagccgcgtacacaaagcaggatatgcgaaccagtattaaaatgagtatttcaaaatccaccaacgaaaacgtataatttaacattcctcaacctaacccagatatatactaaagtctgaccagagcgtattgataaactctgtcagattggttagtatccaggaaccaaatatcatcattccaagaaatacacagacaatctttggcacgaaggtaagcgtctgttcctgaatggacgtcaccgtctgaaaaatactgacgatcagtcccacaaccagagaaataatcagcagcggcgccgagcacaaaataattgtatacaatgcctgtctggcaatgtctaatacctgtccttctgtcatttcacttcatctcctgttccaaatgcacgcatcagtaaaatgtctttacaacgcttccaatcaccagattccagccgtctgccagaataaaaagcagtatcttaaacggcagtgaaatcgttgtcggcggcagcatcatcatacccatggacataagtaccgatgccactaccatatcgattacaataaacgggatataaatgaggaatcccataataaacgcataccgaagttcgctgatgataaatgccgggatcacggttgtcatcggaacatcgtaataaagctccagtgtcatctgatccggataatcttctccatcaatatccataaataggtgcagatccttttcctgtgtctgaccgtacataaagtcgcgaatcggtgtctccgctgccttgtatgcctcctcaatggtaatgtcgccattgtctaacggctgtatggcatcttcgttaatctgctgaaaggtcggccacataataaagaatgtcaaaaacagggcaagaccgacgagaatctgattcggcggtgctgtctgtgtaccgatcgcggtgcgcaggaaatgcagcacgatgatgattctggtataagaagtcatcataatcagaatggacggtgccagtgaaatgatcgtcagcaccagaagtgccttgatcggcgtggatacggctccggtgtcgttgttgtatgtaatggacaggccgttgttgatatcgctcgtcgcatccgtcagtccatcgctgctatcggtattgctcaagccagtaatcatatctgaagatgtatctgccgcatagactctggtctgtcccatggacaacgtcaatgcgatgatcagcactgccaccgcaaagacaaacgacataatacaatatgatttctttaattttgattttgtcataatttaatcctgttttttcgggaaatgttcctttaacttctcaagcgtctcctggaaggtcatctgacctttttctccattctgtccgggagtctttccgttgcagatctctgcctccgtaagtcccatctcttcctcggtaagctttgcgagcatggtcacattatcttttgcaaccgcgatcacaagatacacatctcccatttttattacctgaaccagtttgttgttggcgatccgtatggtatcgaccacctgaaagctgcgtccggacatctggaccttctgatatccgccgatccatttggttgtgaaataggtaatcacaagaacaaacagaaaaataagcaggacgccaagcagctgtataaaactgttcaggcttgaactgagtaaaatcatattagcctactactttttttactgcctcgagcacacgctctgcctggaacggctttacgataaagtcctttgcgccagactggattgcctcgataaccatggcctgctgtcccattgcagagcacatgataatatttgcattcggatcgatctctttgatcttcttcagcgcctgaataccatccatatccggcatggtaatatccatcagaaccagatccggctttgcatccgggtacttctcaactgcaactgctccattctcagcctccgcagcgatctcataaccattcttggttaagatatccttaatcatcattctcataaaagctgcatcatcgcaaatcataatctttgccataacattctctccttgtttcttttcttatattgttttgcttatattgcttttcttatcctgtttccaatcactttacaatctcggtaatacggataccatagctttcctctataataaccacttcacccttggcaacgtatttgccgtttaccagaacatcgatcggttcacccgcaatacgatttaattctataatagttccaggtgcaaaatcaagaatctctttaatagattttgaagttcttcccaattccaccgttacctcaagcggtacatccttgatcagatcaatgttttccggtccgtatcccaccggaacgcttccggtaaacgcctgaaactgtgccggctgtacatttaccggctgctgtccatacatctgtggcatttgctgtgccatcatcggttgtcccatcatctggcctcccatcatcggtgctcccattgccggctgtcccatctgcggtgctgcctgcggctgtggtgccgcctgcggctgtggtgccgcctgtgcttccggagcactacctttgctgcctgcagtcgaattcgtatcttcctccatattctgtgtcacactctcacacatttcctttgcaaaaggaatcggatacagctgcatgatatcactgtcgaccagatcaccgatctccagtctgaaccgtatctttacaaactcgcctgccaggaactcatcgatgacgctctcatcgattgtctcctgtaaatctatcaaatccgcctgtggcgggctgatatcaatcactttgttcagcatggatgacatggacgtcgccgccgaacccatcatctggttcatcgcctcgctgatcgcactcaagtgcagctcgccgagctctccatccgtattggttccatcaccacccatcataagatcagtgattacttttacatcgtgttcctttaaaaccaatatgttgctgccatccagtccgacagtatatccgatccggataaacacacatggcttctcatatgcttcacagatatcactccagtttgcgaaagaaacaactggagtcgagatctctacttttcggtttaccagagaaaacagcgtggtcgctgccgttcccatactgatattggcaatctctccgattgtatctttttctttctcagtcagtacctcttctttgggctgctcgctgctgtcctcagacccgttcagtaatgcattgatctcttcctgagacattactccatccatacttactgctcctctctgattactgatgtcactcttactgcataattatcaccggatgcacccggcagagcagtaaatttttttatatttccaacatacaccgacagatcctgatccactttggtgtcgagacggataatgtctcccacctgcagaccaaggaaatcattgactgatatactactgttacccagcacagccttgatcggcatcggtgcccgtgcaataagtgcctcaatggtctctgtatattgctgttcatccttctcctgcaggctggaataccagtatttcgtattcagcttgtccatcacactttccaatgtgatatacggcaggcagatgttgatcagtccctcgacatcaccaatcttaatatttaacgtaattaacgcgatcatctccgtcggggaaatgatctgggcgtactgcgaatttgtctcaatccgctccagtctcggtgtcagttcacacacactcgcccacggttccaccagaagattcacgcatacgttatagatccgctcaatcagaagaagctcgatttcggagaactccctcgccttgtcaagcggcgccccctggccgccgagcatacgatccacgatcgtaaagccgacattctctgcaatttcaataatgatattgttattcagcggagcaaaatttacaattccaagcagcaccggattcgatagtgcattcgcaaactctgaatacgtcaccgcctccgaactcatcacttccacctgaacattttttcttaggtacaccggcagattcgttgaaagcaatcttccataatgttcaaaaataatctcaagcgttcgcaaatgctcttttgagaacttcgcgggacgggcaaaatcgtaatttttgacctgtttttcattatcatcttttatttcatctacatccagttcaccgctgctaagagctttcagcaaactgtctatctcattttgagataagacttcacccattctctctcaccacctaatgtcttattctagtgtgcttccgttgccacgcttgagaaattcacgcccacgatgtagtcggatccgaacagatcctgcatcttggataaaatctcctcctttacagccttctgtccatcggcgttaaattcctcctcggtatacttggccactaccgtattgatgtcgctgcggataatggtctccttatccgtaagctctgtcatctcgtctcccccgtaggtggcataggactcgcttgtcttgttgacggaaagtcctacagaaaatacagcgtaatgcttctttccatcgccgttgtctgccagattcacggtaaaattatctgtgatattataaactgcaatttcttcgatcggcactgcggaactgtctttgttctgtccgccctcgagttcgatgttgattgcagcgcacacctgatcaatcagttcgtttgactttttggtctgcggaataacggaaaatgccagcaccgcggtcagaatcagattcacgagaaccagtgccaaaataattactgtcaataaatttttcttcattatgcttcccttcctattcgttcacaacttctgtcggttccacagtcgcacctgttgtcgctgcttccggcgtatctgtcaccgtctcagtgcttaaagccgcatccgcaggcgtctctgtacctgtgtcatccgtggatgtcccgctcacattcgagttgtatgagttatagattttaatctcaacccggcggttccttgccctgccctccggcgttgcattatctgcaatcggcacatactctccgcggccagacgactttatgtatgcaggatccagtgttgtggtatcccgcagatagttggcaaccgcaagcgcacggtacatggacagtacgttgttgtcctcatacttggaagaatgaatcggcacattgtccgtgtgtccctcgacctcaatgatgttattatcgtaagtaaccagtatcttgccaagcttgttgaccagcggatacgcctcatctctgagttctgcgctcgcagaatcaaacagcagcgcgccgttcatgttaagcgttacatactctgcattaaaatcaacctcgacgtcgtcctgtatcccatattgcgaaagtgcattttcaagttgctgcgccatatcctcagactcttccagttcctgctgttcatatgcttcggtaatgtctttttcttcctccgtctgtccgtcagactggctgctcagctgctggttgtaataagaatcaaaattctcaagctgactgattccggaagaaatcaattcaccctcgccgatcgatgctccgcctcccgggagtatgctgaatgtactctggaaagaggcaatgaccttctcaaacttttcctcattcacactggacatggagaaaagcattacgaagaaacagagcaggagattcataaggtccgcgaaggtattcatccatgcaggtgagcctttgggtggatcttcctttcttctcgccactattcctcacctccgacactgccctccgcagtttcctctctcgctgaaggtgacaggaatgacttcagtttttcttctatgacacgtggattctctcctgcctgaatcgacagaataccttccaccgtaatttccttcatcatcatctcgttattattgtttacagaaagcttggatgccgtcggattacacagccagttggcaatcaacgaaccgtacagtgttgttaccagtgcgactgccatcttcggtccgatcgttgatgcatcattcatatccttgagcatcaggatcaatccgatcagggtaccgatcataccccaggcaggaccaagttctccccatttttcccagacagcgattgactttttgtgtcgctgctcgatacagcccagatccgtctccatgatacctcttaccagttccggatcggtaccatctaccacaagcatgattccttttttgaggaattcatcctcgattccgtttgccgcctcctcaagtgcaagcagtccctccttgcgggcggtatttgacaaatcaatgatattccggatgactgccgcaggatcctgcggtacctccttaaatgttaatgtaatactcttcagacctgcaataaaatcctgaagtttgttggacgccaatgtacccgatatggaacctcccagtgtgataatgattgaagggaagtcaaacatattgaaaagacccgaagctccaccactggaaaatacaccgaacaaaaacattacaacgccaagcagcatccctgctaaagaagctatatccaattcttccacctaccatccttgatattatagtattgctgtctccaagcggagactgaaatctcaacaagttgtcatcctatatcttgtataattttactaaacttttgaccgcttgtctacttacttttgcaaattctgtgtttcttctttcatggaaccgggattttatcagggagacaaaaccccggttctccaaaatcttatccgtgatgctgctctgtcatctcgcagccgcttatctcttcaggttcacaagctcctcaagaagcgtatcggatgtcgtgattacacgggagttcgcctggaatccacgctgtgtggtaatcatctgcgtaaactcggtggagagatccacgtttgacatctctaactcgccggatgtcatcttgcttccgtccgccgtaatatcctcaccgataccatcgaactcaccggagttcaaggtcgtgctgtagcagttctctccgactttctcaagacctgccgcattggcgaactgtgcgaccgcgatctgtcctaacaggttgcggttaccgttgtcataaataccgtagatctcgccgttgttgctgactgaaagtccgatcaggttaccgagcttcttacctgctccagttgttccgtctgtagcgcctttgctcatcgttacagtggacttgccgccgttgttcgtattctggcaggtgctgaagtccacattgatatttgcgaactgtccgccgaacagggacatgttcagtccaacactcttcgcatccgccacgtttccaacctttgaaaatgttccatcgtccgtgttgaagcttaatctgtgatatacactgttgtatgtaagtgtcagtgccccggttgttccgtcaaccgcatatccggtgccatttccggtgtaagcatccgctttcgccagaatgtccgctcctgcaccgtatacctgtgtcaggctgagtgcccctgctgtgacaaccgtcatgtccgtcgcactttttacctggtcatagctgtgtgtcgctgcattgtactggtagtaattaccgctcttgtccacgatgacgttagcggacacataagtgtaatccttgccgagcgtataactctttgtcgcatcctcggtgttaccgaacagtgcgtttaacgccggctgtcccgcctgaatattctcaggatcgtagtaggtatttccgtcgccgtctaaaacattcaacagctctaccgtgaactctccgtccgttccggttgacttaatggaaaaacgtgcggtgtactcatatcccaggttatcgtagaacttgaggttcttgatcaatccgtcgtcactcaatacgtcggtatcgttcttatcaataataccgccgcaggttgcctcagaggttgcctctggtgcgcttgtcagattctccgtgctcatgacgcgcaacgcggatacggtatctttccggatatttccggttgtcttatctacctgccatcccatgaccgtatatccggtagacgtcatacacaggttgcctgcaccgtctacatagaaagatccggatctggtaaacagattggaagatccgttgttgacaataaagaaattggtggtcgactgatctgtcatacgcagatcgaaagctcttccggttgtctcagctgcacccgcggatgtaatgctgatatttaccgcacctgtggtcacgccaagaccgatctgcttggcattcacaccgccgactcccgtagccgcatttgctcccgatgctccggatgtgttctggtagagcatatcctggaatgtcacggaagaagacttgaatgctactgtgtttacattggcgatattgttaccaataacgtccatttttgtctgatgtgtcttaagacccgacacagcagagtacattgatctcatcataatgaaatgacctcctgtaatgtctggtgccctgctcccttctgtcattcggggagcttctgcctccttgtaaggtccggcatattatacaatcacggcaccgtcaatatttgtaaaaatattactctctgactcactctgatccatggctgtgaccaccgtcttgctcggaacattcacaataaacgccagtgaatccagaatcacgagtgattcccgtattcccttttcgcttgccttcaaaacaccggattccagtctctcgttctgctcgtccgacagattgatgtgtctgtcattcaaacgtccctgtgcatgtttggaaaaccgaagttcctgactttctgcggtcgtctgtttctgtcttaatatatcctcgaaagaaacactgttttcctgcgccgcagtctctgtgcttttgcgattcagataccggtcagttacctgttcgatggaagcaaattggttcgtaatcttattcataaccaacgctcctttctcagatcatccagctttcttctcaagctccgcaatcttagcctcgagtgctgtcagctgatcgtaggaatccttgctgatataagtcttctctgtggtggtcagcgaatcgtaattcttgcgaagtgcttccactgcttccttgttctcaagggtcagctcgtccgcggatggaatctgcgaaagcgcattgtcaaataccaggctcttcatggttccgtccagcttcacaaacgttgccagcgtatcgctgtcaatataactctgctgataagaagtcagtccgttgtacacggttgccaggttctccacatccgtctgatatgccagcgtcagcttatccgcatccggaagctttgccacagatgccttgaatgcctctgccagtgaaaccgcctccatgtactcggtgtctgccacctgatatacatcgtcgagtgaataacggttgccgttgacataaatgtatttctggttgttctcgtactgcacataatccacgaatcctgccaccgccgtcgtctcgccggtcgtctcggatgttgtctttacaatgacatactttccaaccagatcgtttgccttcgtgctctcaatgctgttctgcatgttcagcatggactccatctgtgaaaaagttgccagctgtgccacatactcggtattgctcgtcggttccagcggatcctgatactgcatctctgcacataacagctgcaggaactcgtcatatccgaggtcattgccggcactggtcgttgtctctgtcgtactctctgtaatcttgccgttctctacggcctgtactaatgccatatgtctctcctttctgtctgttatgcggtaaagtcaacggaattgccctgttctgccatcatcttcgccaccagagtctcctcttccgtcatcagcccggacagtccgtccagttcattcaggttgatgtgtctggtcgcattggctgccttttcccgttcctctgcctgctgttcttcctgttttgcattctgctccagattcctctcgaattcatgtccgccgacggttacctccacggcatccacctttacgccagcctggttcatgttctgcttcaaatctgcgatctgactttccagtgcttccttgaccacttcattctgtgcggtcagatgtgcggaaaccgttccgtcttttgacgtaatctccagataaatcttgcccaggtgctccggattcagctgcatctccatcgtcgtttcctgattcgccgtgtaatttactctcgtataagtcacgatctgacgcacgacatctgcgatgtccacctgtgcggcatattctcccgcactattggcgccctgcattgccacggtctctgtcagcgtcgggccggtatgtacatccacgcccacatgtgcctgcgacgcagaattctgctgtccggaattggaatttgatccggtctgtgcctgttccttatccgaccctgcagctgcatcggcagctgtctcttcctctgcgcctgcatttgctgactttgcctgcgtatcagtctcttccggagtgatgtcttttgcttcttctgttctggtctctgtctctgctgcctgggcagccatctgcggctgttctgccgtatcacggattccatccgccgtatcagcgtaaaccttctgcgcatctgtgacatctgtttcaccagcatccgctgtctggactgtctgcatcagatctgcatccatgtccgtctgtccggcatcctccaaaagctgcgtcaattcctcagccgtgactcccagctgctgcaagagatcttcggtcagtgttcccaccgactgcatcacgttcataaacgcttcattacagagaagtgcgctcatgtcttcggttccggttaattctgctgccagagctgcaagctgctgcggattcatcagatcggccacggtcagtcccaatgtctccattgcttctgtgatctgctcgtccgtcacctgaagttcatccttaatgacgtctctcacactctcctcaaagctttccagcttctccgatacctgactgccggctgtccagtccttcgtgctttgctccggcatcttattcttctgatactggtaacggtcataattctgctccggactgtgcggtgtaagctgctgcatattctgcgctgtctgagatcctgtacttacgctgcttcccgggatctgtgtcatctgatcgaccatcttccggaatgtggtgccgatatccgcgccatcaacgcctgtgacactctgtccactctgcgtctgcatcagcattttcccaatgcttgcaacattattgtctcccattctcttcctcctttcccatagctgcacctgcagcctgatttttgaaggaatccctctgccactatgagaagcagactgtccttctctattctacaggttccatgatcgcggtcacctttgctgcagtagccgcgtccattttgcccagaatattcgctctcgattgtgcgtccatgctgtctaagatatctgccaccagctgcagattatctgtcatggtatcaaaaattgcagccgcctcttttggcttcatggaagagtacgctttcacataatcatccatctcgtcgttggctgccgtctgttctacaacctgacggtaaatgatctccgcatccgcaggatcaatgctctcataatactgcttatattcctctatatcgggtgctgaatctgaaaacacaacctcctgatagaacttttgcttctcagcctcaaaatccgcctcgttctgcttgtactgtgccagttctgcggactggctctcaagctgtgcgatatattccgcatttgcgctggacgtattctgtgcatccgcaagttctttctccagttccttgattctggcaaccgcatcgtcaatggaagtatagccgtaagcgtcatcctccgttgacacttcctcagtcgcgctgtccggcaggattttgttcacataaggaacatcctttaacaccggcgccagaacggatgatccgaaaccgccgacatcgcacttgatcaacaggacgatgatggcaagccagattaaaataatgatcagggtaacaaagaacacggcaatcttgccgccagtcgatgtctcgtcatccatatccagatcatcatttaactcttttgcctttttccggtccgctttcttctgtgccttcgcttctgcacgtgcagccttctcctgtgcctttgctgcctttttatctaatacttcgtctttctcttcttctgccatttgagacctccgtgcctatccttcatggtaattgtagctaacaagctcgtctatttccttgctctctgcctgggcgatttcctgcttaaattcttcaaacgcacgctccctgagcttctcatgcgtctttcgctccaccatcacccggttcagttcgattcgcgccatctccagcgtcttttccgcggcgtgcaccttcatcatctgtgctctctgcagactcttcatcacatcgatcgcacgcttgcattcccggatctcctggatatccagcgttccgttgaccagttcttttgattttctctcgtagccggccctgcgcatcaggatctctcgaagcttctcctgctcttccgcaagctgtctgctcgccgtcgcatatgcaatttttgcctgattctccagcttgatcttgatgtcaagaatgttctgcatccggtatgtaaactttgccatacactgcgcctcttttccgcggagcgttcttaatcttcaaatagtttcttcaataaatcgatttcctcgtcaaacaggaacttttcatctgtcctctggcacaggaactgattcactgcgttgatcttctgaaccgcatagtcaatctcacggttggaaccgctcttgtaagctccgatgttgatcagatcctccgcttcgttataagtagccagtacattctttaaacgtccggcaagctccttgtgctcgctggtcgctatggcgctcataacacgggaaatactctgtaaaatatcaatcgccgggtaatgattcttgtgtcccagttttctggaaagcacgatgtgtccgtccaaaatgcttcgggctgtatcggtaatcggctcattaaaatcatcaccgtctactagaacggtgtaaagtcctgtgatggaacccttgtccgaagtaccggcacgttccagaagcttcggcatctccgagtatacactcggcggatatccccttgttacaggcggttctccggacgcgaggccgatctcacgctgtgccatggagaatcgggtcaaagagtccatcatcagcagtacatcttttccctgatccctgaaatattcggcgattgcggtcgccgtcttcgcagccttgttacggatcagtgccggcttatcggaagtcgccaccacgacgacggaacgcttcattccctcttccccgagatccctctcgataaactcgcgcacctcacggccacgctctccgatcagggcaatgacattaatgtccgcttttgtattgcgggcgaacataccgagcagggtgctctttccgacaccggaacccgcaaagattccgatacgctgtccttttcccacggtaatcagcccgtctaccgcctttacgccaagcggaagcacctccgagataatcttacggctcatcggatccggcggatccgcctcgaccggatattcgcatccgccctcaatgactccgccgtcggtcggtcttccgataccgtccagtgtgtgtcccagaacgccgtccccgacaagcaccccaagcggatgtccggtattctcaacgatacatcctaccccgatgccttccacattttcaaacggcatcagcaaaagtctcttatccctgaatccgactacctccgccatcaccgcgtggtctttctctctgtcaatgacaattctgcagagatcgtttaactttgcatccggtccgacagattcaatcgtaagtccgacaatctttacaacctttccaaggcggttgaagtaggtcttttctccaagttgtaaatatttttcaaattgatgtgtcatcattctctcaccttacgaacataaagaccggatatctttgatcagattctcaagctgtgtaccgagactgcagttaaacacgccggaatcggtctctatcgtacagtcatttccctccaccgtcgcgtccgagacaatctcaagctcaatgtcatgtcccacacgatccaggatctcggtcttgtgattctccagaaacagtgcattgtcctccgccaccttcacccggaaccgcttgtcgtcttcaatatttaaaatggcatcttcaatcagatgcatcagtatctcttttttgtcgtcaaactgaatatggaacactttttcaaagacggtaacgatgacatccaccagatcctgttccatatgttcgcgtttgtccctgtaatcgctgtcaagatctccctgctttttcctgtaggactcctcaagctgcacgcgaagctgctcattctcctgctccgccgaagctctgccctcctcgtacccctgcgtctttgcagatgtacggatctcctcggcatcttcgtttgcctgtgccagtatcgcatcggcattctgctgtgccgccgcaaggatctcctcggcttttgcctttgcctttgcctcataatcaatctgcggctccgctttgatgacctgacccggatcacccgtcacaagtccggctgaaaatccgccttcctcttcctgcacattctgtgccggtgtctgtgtctgcggcagatcctgtttcaggtgctgctgcaggatcacattggaatcgatgatgcgcgtgtttgtggaatccgtctgaacaaaccactgtttataaagattagacaacgatctcgtcacctccgcctcttgagattacaatctcgcctgcatcctcgagtttacgaatgacgcttacgatcttctgctgagcctcctcaacatccttcattcgcacaggtcccataaactccatatcttccttgatcatcgcagcaagacgtttggagaggttcttaaatataacattctgtacttcctcgttcgccgccttcaaggcaacgccaaggtctgcattatccacatctcgcagtacacgctggattgcacggtcatcaagcagcagaatatcctcgaatacgaacatcttcttgcggatctcgtctgcaagctccggctcttcgatctcgagagactccatgatatgtttctcggtcgaacggtcgactgcatttaagatgctgacaatagcgtccacgccgccgacgattgtgtaatcctggttgaccagggaagaaagctttctctcaagtacccgctccacttccttgataacatccggcgatgtacgatccatcatcgcgatacgttttgcgacatccgcctgtttttccggcggcagcgcccccagaaccatcgacgcctgcggtgctgtcagataggacagaatcatggcaatggtctgcggatgttcgtcctgaatgaagttcagcagctggcttggatctgtcttgcgcacaaactcgaacggacgcacctgaagggatgctgtcagcttggagataacctcctgtgccttgtccgcgccaagcgccttgtcgagcagttccttcgcataaccgataccgccctccgcaatatactgctgagccagacagatctgatagaactcgtttaagacatcctccttgacctgcggtgaaatacttctggtatttgcgatctcaagggtaagttcctcgatctcgtcctccttaagatgcttaaagatatctgctgaccgctccggtcccagtgtaatcagaagaattgcagctttttgcagtcctgtaaattcctcgttttttgccatattactcccactcctcgttgagccagttgcgcagtaacgatgcagccgcctccggtttttcttctacgaatttttcgatcagtaaacgcgtctcggacttctcattgtagccgatgtcctcaagcggctcctggttctcttttgtggattccagcaggctttccacggaaagttcctcctccatctctgcctgtttctcctttctggtgctgcggaataccacataaccaagcaggagaagaatcagtaccgcaagtatgatctgcagataatccgacagggttcttccaccggaagaatactggaaaatcggctcgtcataagcgatgatgctgatgtttgcctcaggaaaccccgttgcgttggcgatcatcgtgtaattatcctgatccaccgtcgtcttgaccgggtcactgtttgccgcaatatactcgtcaaatgtcatgttatccagcgcaccggatgtcctgagtgtgtcctcatcatagatcacataattttttaccacgatcgcaatggaggaagtatcgtaattgatcgttccggtcgccgccgtgcggtccgtcactttttcattgttctgatactttgtcgtggtatcggtgatcgtggactcggtataattgttatcctcaatcacataggatgtatcgtcattggaatctgtgcccggtgtggcagctgcgccgccgacactgttcgactcataattgctctgctcatcgatcataccgtttgtctgaccgtctggtgccgaatactgtcgctccgtctcgcggtatgcgtcaaaattcatatccagctttgccgccacttccgcatgatcataaagtcccgagccgaccagaacatcctttacctcgctctttagcagattctccgtcttagttctcagagagagagctggctgctcgcggttccgaccgacgaatcagaatctccgcccgaaaaaaggacattggagttcgagtccagaatcagaacgttgtccgtcgtgtcattgccgagctgtgtcgctatgtactgtgccagtccctgtgcctgctcgtcgctcatatctgaattcaaggtaagaattaccgccgcgtaggaatcctgctctctcgcaagaatcgtgccatcatcattcgggatgtccagtgtcacagacgcgctctcgacgtttgacagtgtctccagctgatctgcgaaataattctccagatacagcttgtatttcttggtcttgtccgcctcggtggagctgaatccgccgtcaaacacattgtcaatggaaaatccttccgtcgggacaccgttctgcccaagcagaatcgacgccgccgcattgtccttttcatccacatagaatgtcagcccgtcatccgacatctggtaggagatgcttccgtcattgtccagaaggtcttttacttcacccgcctgcgctgtggaggagcactcgataagcgttaccatgttcggcttcccgacaaccaccgccagaatcaccaatgccagtataattaccgccacaatgcttccgagcaggattctctgcttggttgtaaactttttccaccaatccgttatcttcgttaaaatcttttgcacctgttccggcataatttctaactccattcattaaatctgcatgttcatgatctctttgtatgcatcgagcatcttatctctcactgcaactgtgtactgcagcgcctcatacgccttggctgccgcaatctgcatatcgtgaggattgtccgcctcgcccagcgcgaactggatctttgccgactgcgaatcattctgcagatcattcgtctcgttgagcatattgatcgccgaagacaacaccgagtcaaagctctcatcggtgtccacagacaacagtgtcttctgtgttaccgcactcatgtaatccggtgaagtggcattcgtcaataaactgatatccatctgtatttcccccgtttcatcctaatctatgtcttactgaccgatcttaagtgccgcctgaatcatgctcttgctggcattaaacgccgtcgtgttcgcctcatatgcacgggacgcgtcaatcaggttcgtcatctctgtcaccgtattcacattcggataacgcacatagccgttctcatccgcatccggatgggacggatcatactccattgtaaaatcggtctctgtatcttccttgacggaggtaaccttcacgccgttgcctacagcccgcgctctggatgactgataatatttgctgaacggagtcagatccttttccgcaaacgtcacaatcttgcggcggtacggttcaccgtcctccgtacgcgttgtattgacattggcaatattctccgcgatggtgtcgatgcggaagcgctctgccgtcataccgctcgcactgatgtcaaaagactgaaataatcccatatgctacctcctgtttatttaagcactaatttcatacgattgaattcttcgttgatcgatgtcgtcagcatctcatagcggagctgctccgatgccagttccacctgctccgtatccacatccacattattgcggtccagacgataggaataattggaggaatccgtataggtagacacatctaagcccgaaagatccgagttcagtccccgcactttcttatccagcggaatatacttcgagctgccaagctcccgtttcagcgcagattcaaaatccacatcctgtctcttatagcccggagtatccgcatttgctatgttgttggaaattgccgactcacgtttccagctggcatccgccgccttatccatgatgttaatatagtcgaacgcattcgtagttatcatatgtatcgccctccgcttcacctagtttcccaaactatcttattctattataaaatatggtttcgtaattgcaagagatttttgttattttttacactatcttgtagatttttgcataataagtacaagatattagcaaaattgtcaaataaacccgcataaaaagccacgttccacggaaataaaaaagagcgcacccttcgatacgccctttcgtcctgtttattttttctgattctgctttttgatcttgtcgagttcgtcgaatacaacgtcgttcaatactttgatgtaggttcccttcatgccggaagagcgcgactcaatcacgcctgcactctcgaacttgcgcagtgcattcacaatgacggatcgtgtgatacccacgcggtcggcaatcttgcttgctacaaggattccctccttgccgtccatctcatcaaaaatatgaatgatcgcttccaattccgaaaatgacaacgtgctgattgcagatttgacaatctgaacctttcttgtctcctccgcattctcctcattcacggagcgcatcatttccagaccgaccacggttgtcccgtattcgctcaaaatgatatcgtcaatatcgtactgtctgtcttctctgtagacaaacagcgtgccaagccgctcacccgcaatatcaatcggcgtgatgatcgcagtgtattccttcacgtgatctacgaaacctaacgtctcaagattgacattctccttggtagagaggattccgagcagacgttcgtttagcagcgggtcgatgaaacctcccacctcgtccacgatcaattcctggatctcatccactccgggacacacgcccgttccaagaacctttccctttttgctgatgaccagaatattggatgcaagaatatccttcaacacatcgcagatatcattaaacacgacctttgaagagctgttattgtgcaacagcttattgatttttctggttttgtccaacaattgaacactcatgtccgtgcccccatttcgtttcgaatctctttttcgttatatttcatattttaacacgtcaattctgaaaattcaatattttcgtaatatttgacatatttttttaactattttgtatcctcgtccgcttttctgtcacgggtgtagccgcatcccgcatctgcacaggcgatcttattgccttttaccaccatatagccgccgcacttcgggcacttctccgctaccgggcgtgaccagctcataaaatcgcactccggattattctcgcagccgaaatactttctgcctttcttcgtcttgcggaggacaacgtcttttccgcacttcggacatggcacgccgattttttccagatacggcttcgtgttcctgcactccgggaagcccgggcatgccaggaattttccgtgcggtccgtattttaccaccatgtttcttccgcactggtcgcagacaacatccgtgacctcgtcctcgatcttgactttctgtagctccttctccgccacttccaccgcggcttccagatccggatagaaattccgcacaaccgtcttccagttcacagcgccctctccgatgctgtcgagcagcgactccatattggcggtaaaatgctcatccacgatgctcgggaaggattccttcataatctggttgaccacctctcccagctccgtcacatacagattcttcgcttccttgacaatgtaacgtctgccaagcagcgtcgtgatcgtcggcgagtaggtactcggacgtccgattcccagctcctccagcgtcttgactaaggacgcctccgtgtaatgcgccggcggctgtgtaaaatgctgcttctcatcgaaggtgtccagcgtaagcttcgtatcctcatcgattcctttcagcagaacattgttcgtgtccttctcgtcgtcctcgctcgtgtacacagacataaatccctcaaaggagacctttgatgccgcgacaccaaagcggtactttccggcaccgatcttcacgttcgtcgtctcatataccgcagaagccattctgcttgcggcaaaacgcttccagatcagctgatagaggcggaactggtctctggaaagagattccttgaccaccgccggtgttctcgcaatgtcggaaggacgaatcgcctcatgcgcgtcctggatcttggcgccgcccttctgggtaacggtctgtgtcgctacgaattcttccccgtaattctgtgcgatatacgctctcgcatccgcatccgcctcatccgaaatacggacggaatccgtacgcaggtaggtgatcagaccgaccgttccctgtcccttgacgtcaacgccctcatagagctgctgggcaatacgcatcgtcttggagatcgggaaattcaatgtcttggatgcctcctgctgtaaggtactggtcgtaaacggcagcggcgctttcttcacgcgctcaccctttttcacttccaggacttcaaaccgctctccgcggatctcgtccatgatacggtccgcctcctcgcggcaggtaatcgccagttttccgttctcgtccccgtggaactttgctgtcaacggcttcttttcgccgtccgccttgagctttgcatccagcgtccagtattcttccggaatgaatgcattgatctcgtcctcgcggtcgcagatgatgcgcagtgctaccgactgtactcttccggcgctcagcccacgctttacttttgcccacagaagcgggctgatcttgtaacccacaatacggtccagaatacgtctggtctgctgtgcgttgacaagattcatatcgatatcgcgcggctgctttaaggacgccttgaccgcgttctgcgtaatctcattgaagctgattctccgcacattcttgccgtccagctttaacgcctggcttaagtgccatgatattgcctctccctcacggtcggggtcggttgcgagatacactttgtctgcctttttcacttctttacgaagcttggcaaggatatctccctttccacggatcgtgatatacttcggttcataatcatgctcgacatcgattcccatctggctcttcgggagatcccgcacatgcccgtttgaggcaactacctcataattttttccaagaaactttttaattgtttttaccttagcgggtgactcgacaataacaaggtacttagccattcatacatctcctttatgctgatttctcaaatccgtctgatataacaattcttaaatgcttccgtaacaaacccctttttcagaagaatccccagaatctgcgccagttcgggcacagacaggtctgtctcctccagaagttcttccatacttttcggtcgtaaatctacacaactatacaccaagcgttcttctttttcaagtaataatttttcaaaggtgcatgtctccccgcccgctccgggatccggcgcaagctcctgtataaacgattcgagatcggaaactgcccccgctccctgccggattaagctgttgcatcccgccgacaaggcatctgtaatcctgcccggaatggcatagacatccctcccctgctccagcgcaaaatccgccgtgatcagcgatccgctccgctgctttgcctccaccacaacaaccgcccggacaagccctgatatgatgcggttgcgctgcggaaaatatcccggaatcggctgcgtgccgggcggatactccgagacaaccgagccccgttccagaatctcctcatacagcacccggctgctcttcggatagcagacatccacgccgcaccctaagacggcgcagctgattccgcccacgtcaagcgctccctgatgccccgcagcatcgatgccgcgcgccattccgctcacaacaccgacgccgcgcgccgcaagcattctcccgagctcccttgcaaccgtccgcccgtattcggagcacattctcgcaccgacaatcgcaacggtctctccctgcgggaggcatccctttacatacagtccgtacggcggatttgcgatatggcggagcctctttggataagatgcatcctccagcgacacaaacgagatcccggattcacacatcttagcgtacgcttcctccatgtccgtcttttgcgcagcccggaccgcctgtatttcttttgccaataattgcagattttccatctgcttttcgctaagaaaatagatatcctgtgcattcccgaccttttcatggatactgattttcgcacagttggagagtccgggaatatttgcaaaccaatacgcataattcatctcttcacctctcccagaactttctgtcaaagcttctgtagcagattgcctcctccagatgccggtcgcaaatccggtctccgccgtccatatccgccagcgtgcgtgccacccgcagaagcttatggtaagatctggcggtgagctgcagctttccgtagatctcttccatatactgctcctgcttcttgtcaagagcacaatactcccggatcttcgtggcaggtatctggctgttgtacgaaaatccttccttccggtagcgctcccgttgaatgtcctgtgccaccgccacgcgcttctgaattgccgccgatgtctcctctttttgctgtccggttaattccccgaatgtcagcgccggcgcctccacacaaatgtcaatccggtctaagatcggctggctgatcctctctaagtaccggtggatcgccgtctgcgtacacctgcatttctgcatatcgggataatagccgcacgggcacggattcatcgccgccaccagcataaaatctgccggatagacataacttccgccaagacgcaccagatgaaccgccccctcttccagcggctggcgcagcgcctcaaccgtctccctggcgaattccggaagttcatccagaaacagcacgcccttatgtgccagtgagatctcccccggctgcgggattcttccgccgcccgtaagcccctgcacactcacggtgtgatgcggcgcccggaacgggcgctgcgtaagcagaccgttctccccggcaagcattccttttacactgtagattttggataactccatgcgctccgcctccgcaagcggcggcagaatggacgggatacgcgatgccaccatggtcttgcccgcacccggcggtcccacaaacagcagattgtgcattccggttaccgcaacttcacacgcccgcttcatcagccgctgtccgtggatctccgaaaaatcaggaagcactgcgggctgtgtttcttctatattatattcctctgcggcgtacttctcccacgacgcatcctcaagaagccgcatgacctccccgatattttccacaccgcagacaagcatcccggaaacaagcgccgcctcttttcgattcgcccgcggcacaatgcagcgccggattccgcgttcctttgcctccgccaccatcgggagcacgccgtgaaccggctgcaccacgccgtttaatccgatctcacccacgatcagcacatcatccagtaccgcatgcggaagccttcccatcgcagccagcaccgccactgcgatcggcagatcaaacccggctccggatttgcggatgtccgccggcataaaattcacggtaattctgcgcggcggcagcgcacaccccacattgcggagcgctgtgcgcacccgctccctggcttctttgacctcagacgccagaaaaccgaccatctcaaaaacaggcatcccgtcgctcacatccgcttccacgcagacaggcacactctggataccgcgtatcgttgctgttgctactctgctatacaacctgttctccttttcattatagaaagatctggaatctctgtgcagtgaacactgctgaatatcttagaaaatacatttgttaaaaagacatgtttagtataacatcatttgtagaaaaagggaagcggcaatttatctcccgccccccgcgctttccattccttttcgcagtttttccagcgcccgtttctcgattctcgacacatacgagcgggatattccaagcgccgctgcaatctcacgctgtgtcatcggtttacaggcatagagaccgtaccggttttctatgatatagcgctccctgccggaaagcagcttcggcacaagtgccagcacctctctggtgcgtctgtcggtctcgatcgtctccaccacatccggttcatcgctctccacaatatccagcagatgaatctgattgccctctttgtccgttccgatcggttcatacagagagacctctctggccgtcttctttttggaacggaaatgcatcagcagttcattgtcaatgcatctcgccgcgtaagttgccaggcggcttccgtaatcttctttataagtagagattgccttgatcagaccgatggttccgatggagatcagatcttccatatcttcatcggaattctgatattttttcgccacgtgcgctaccaggcgcatattccgaagcgtcagttctttttttgcctcaaggtcgccgtctttcatttttttcaggcattccatttcctgttctggtgtgagcggagataagaaagttttcacaacgcacctgaaaagctttattgatacattctatgtatgggccatgttttccgtgcttttcccctcttttttccgcaaacaaatacatgccgtctttacatctcccccgccgcttcgctataatagcgttacatgaaacaggaggaatttttatgctgcgcacccttacctaccgcattttatccgccacggacgggcagaccattctgcattatttaaaaagtctcggctattccgggccgatactggtacatttaaagaaaacagaccacggcaccctcttgaacggcgtgtgggcgcatatgaatgaaacgcttcacaccggcgaccttctctgtcttcatctggaggagaatacttccggcacctccatttttccgcagcagattcccctcgcgatctgttacgaggacgaagatcttctggtgattgacaagccggcaggcatgccggtacacccgtctgccgcgcaccagagggatacgcttgcaaacgccgtcacgggatattaccgtgcaaaaggcgaaatccgcccgttccgctgcatcaaccggctggatgccgacacgagcggcctgatcatcgtcgccaaaaatatgctctccgccgccctgctcggcaaagccatgcagcagcgtatgatccgccgggaatacctcgccgtcgtatgcggcacgctcaccggaagcggcaccgtccacgcgccgattgcccgcgtaaaaccgggcgatgtccgccggcaggttgattttctctgcggggatgatgccatcacgcactataaaagtctcttatgccacgccccctattccctgctctcccttcatctggaaacggggcgcacgcaccagatccgtgtccacatgtccgcgctcggctatcctctggcaggcgaccagctctattatccggcattttcagacacaaaaataaaacggcaggcacttcattcccaccgtttgtctttttctcatcccgtcaccggggagatgcttacgtttacttctccgcttccctgtgatatggctgcgctaattgatccagaaccttctgctcataggggatcttccctgccagcagttcttcgcggataaatgtattgacttccggctcgccccggacagcgagccggtacaaaagcagttcaagaagcgcccgcgtatccttgtgcatgacatgaaaatcctttccatgcaggtaatactctaatgcgctccggtcggtatagcgctccttctggtaatttttcgaggccgctacacggtcgatatacatctccaccacgtaccgcagaggcattttcatgccgcagagtcccttgtccccgccctcgtccggcacgccgtagtcaatccagtattccatgtgatgcttgttccgccctttgtggtgcagccacgcggacgagtatcccttatccttgcgctctgcattgttcgggctcattgttccctgataatatttacagcccaccagaaattctgtcggcgtatatttcgacagatcatgtaataatccctgtttgtataaccccaccgcaaaacagcctttcatgaccagatgcttgtgatggttgatcgtgcaaaaatgtttccatgctttcataataatgtaaccttattttcctgttaatataacgacagactgaccgcaaagttcgatccgcggcgcatccacccgctcctcctcttttaggaacggtgcccgctctctggcggtgtccatcagcagataccactttttcttcccgggaagcttcggaagcgccaatctggtaggacccatgtgaaaattgcaaccgacataaaggaatttctccccctctgttccatcgccatcctcttttccgcagtagagcatgcccaaagactgtctctcgccggaaagatctgaaatccacgcattctctccgtgataggacaaatcgggataccccgttccttttgcatcggaaagctgttttggcatatccgcggcgagcacgggatgctccctgcgaaacgctgccatccgcgccacaaactcccggaaccacgcgtagcgctcatctttcttccagttcacccagccggtcggattgtcctgacagtatgcattgttgttgccttcctgggaatctcccgtctcgtccccctcgtataaaagcgggactccctgcgcgagaaaaagcaccgccaccgcattgcacatctgccgttcacggattcttacgatccgctgcttgcggcttcgtccctccacgccgtagttggcgctcaaattccagtcgcttccatcccggttctcctccccgttgtcttcattgtgtttctgctcatagcagaagagatcccgcagggaaaacccgttattgtccgaaatgtaattgacaaatccgtgatactgatgctgtttgcgctgctggcatgcaaatgcatccataccgccgttcttgtgattgagcagcgcccggacgggatacagatattcgtcattgtatacatacagatgcggataacggcacgggtgccagagcacagcgttctcgaaaccggcgcagaaaatcttcgtccgtctaagccacgcatcctgtgcaatctgcgtgacgggcagattctcccccagcagatggaagccatccacatgatactccctgacccagtaacgcagcgcatctaagatcagattctgattgacattctcaggaaaatacatctccatcacacattccatgtgattctcatggagcgcgcggatgagttttttccattcgacggccgcatcctgccctttcgcgtaggacgcctttaccgcaaaataattggcgggcgcatatccccacaggttcacacgctccggcatcgcacatgcttccggcttgatctgatcctctttccgcacctgccagctgatatattccggcaataccgccttctcctttaagatcagttcctcaaactcatacaccggcatgaactccaccgtcgtgacaccaagttctttcagatagggaatcttatcgcgcaccgccgcaaaagttccccgctcctttgcagggattcccgcatccatcgaaaatccgcggatgttgagcttatagaggaacatctcatggcgcgggatctccggatgtacatccgtcccccacgaaaaagtgtcatccgaataaccaccgcagacccggaactcattcttaacgcgccctgcgtctctccagcgctctctgccgatgatgcggtttgcataaggatcggtcacgaccgtcccgctgattttataattataacgcaggctctctgccttaagccccgcgacaaagactgaccggatcgctcctctgcagcagctttccggcaccttcagttcctgccggattccgccatctttcccatacagaagaatactgcagtcctcttccttttctgcctcaaacgtaaacacgactccgccgcctgcggctgatgccccgtattgtctgtaatcgccctcttttatcgtatacgccatgccatcttccacctttgtcttcgctgcctgcacgtctgcatctcttcgcaatgcacctacacatcatttcgctgtgcacctacacatcatttcgctgtgcacgtccggaaaatcagagatttcccggactcacgggctttcgccctatcagccatgaattttaaaaaattttgccttcgcaggcaaatttttaaaactccctgtctggcactgctcaatagccttcgcgtacattatatcattcccgcttgttttttgtatagttttttctttttcggggagaatgcgcttgtccggcatttgcatctcatgttataatattaagaaacgagagttcttattgtcacagtacgatcgaggtgatgtatatgaaacgaatacccacgacagatttaaagcccggaatgttcacagccagaccggttcgcactgccgcggggcagatcatcctggatgagggctgtcttttgagtgcgcagaccatcctgcacatccatgactattccataccggaagtatggatcagggacagcagcgattcctccggcgggcttcacgattatctgcaaaagcagtacgctccggttcgttcccgttccgagcgtatccggcaaagcgaagaatacaagattttcagtcagaagtttgacagctgcactacgatgcttcacactgcgttaaacgactgtattttacgtgccaaaaagctggagacagacaagcttcttgcagggaccctggatttgtttgcgtcgcatactaccacactttccatgttcgacatgctccataacttacggcagatcgacgattcgacttacgcacacagcgtcaacgtcgccattatctcccgcatgctcgggaactggctcggtttttcggaggatgcccagaacacactgactctctgcggtcttttacacgatatcgggaaatcccggattcctgccagcatcatcggcaagccgggcaggctgacttccgaagagtttgaacagatcaagcgccatccccttttagggtacgagctgcttaaaaaccagcctctcgatccgcacataaagaacgctgccctgatgcatcacgagcggtgtgacggaagcggttatccgttcggtctgtacgcatcggacattgacgactacgcttcgatcatagccgtcgcggatgtatatgatgccatgaccgccgaccgctgttatcgtctggggctgtgtccgtttgaagtgatcgcccagtttgaacaggaaggcttgcagcgctacaagccgcgctatattctcacctttctcgaacacattgcgcacacttacctgcacaaccgggttctgttgaacaacggacagaccggagagattatttttatcaataagcgtctgacgagacctacgatccagatcgccccctcacgtttcatcaatcttgaggagcatccggagctctacattcaggcgattatttaataacatccaataaaggagatatcatgatggcagacaaccataacaccaacgaagacgaggatatcctggtcaccctggatctggatgacggcagccaggtagaatgtgagattttaaccatttttaccgtcaacgagcaggactatatcgcccttcttccgctcaccgaagccggcgagccgaacgaggacggcgaggtctatatctaccgctatgcggaggatagcgatggcaatccgtctctggataatattttagacgacgccgaatacgaagccgtatccgaccgctttgatgagtggcttgacgaggcagaatttaacgacatggaggactgagacgctctcctgcctcggcaataaagcgcgagatatctgcatctttctgattcatctgtttgacggaaaagagatgcagatatttttttgcccgcgtcataccgacgtaaaacatccggcgctcctcctcgatgtcctgatccagcaccgccttcttgtagggcatcactccctcgttcacgtcgatcagatagacgttttcgtactcaagccccttggcggaatgcagcgtggaaagcgctacgctctcactctgcttttcctggctctggtacaggcgttccaattccctggtgtaattctcgatgtgcgcaaaccatccgtcataatcttcatagcctcttgcactttcctgtagttcatccagcacatcataaagttcatccgcccggatacgcctgtaatctgcatactcggcacagaactcgtcatatccgatgcctttccggatatagttgatggcggcaaacggattcatccggcgaagctgcatcacatcatgctccagcgtgacgatccgctccgccacccacggctgttccgcctctctgaaataccattcccacacatcgaatgccaccgtgtcctcgtccaatgaatctctgctgatatagcgcttcgggcggttcatgatctgcagaaaatcacggcgttcccggcttccctgcgcgatccggatataggcaaaaatatcctttgcgatccagtgctcgtaaaggttcggtatgcggtctctcgtcctaaacggaatattgtactccatcatctgctccatcagaagacgcggctgtgtgttagtgcggaacagcacagcaaaatcacggtagctctttcccctctccaccgcatcacaaatatcgcggatgatccgcagattctccttccgctgatcctcaaaaacggcatactccaccccggtctccgccgggagtgccgcgcggatgcgcttctggaagcgctccttattgtgcccgatcagattcagcgcatcctcgacaatattggcctgcgaccggtaattcgtgtcgagaagcacggttttcgtccccggaatttcacgctcaaaccgcagcataatctccggctttgctccgcggaagcggtagatcgactggtcgtcatcccccacaacaaacagatttctctgctcacccgcaagcagcctgaccacctcaaactgaatctggttgatgtcctggaactcgtcaatcagaatgtagggatattttttctgccaggcagccagaatatccttccgctccttgaaaagctcccatgtatacaaaagcatatcctcgaagtcaatcagatgatgcgcatagagatattcgtggtactcgctgtaaactctccggaacacctcttccccgcagttcgtggaatagtaatgatcgagtgaaattccgctgtttttcactagaccgatctcccccagaagcgctgcgatgaactccgactcatcctcatattccagcctgtggcgcttaatgatctcacgcatgcagctcacccgctgctcctcgcggatgatgttctccgcctgatagtggtaggcgtgctttaagatcataaaaaagacggcgtggaaagttccaaacgtcactgcggaagattttccgcccatcaggcgcaaaaaacgttccttcatctccgttgccgccgctcttgtaaacgtgatgacaagaatgtttgccggattgattccatattctgttatcaaatgtctggtgcgttccgtaatgacaagggtcttgcccgaaccgggcccggccagtacgagcatgggaccatccttgtgacggatggcctcacgctgagacgggttaaaactcatagattacctctgattatttctgtaacatggaaatgccttttttgattctcgcaatggattcctctttgcctaaaacctccatcagctctgtcgctccgcccggcgtcatctgtttgccggacactgcggtacggatcggccacatcacatagccgttcttcacgcccttttcctcaacatacttaaggagcgtcgcatagagtgcatcattggaaaaatcctcctgcgcttccagcagcggcaggacgtcgcttaaaacctccagcgaggtctctgcattggtcttcatcttcttgtgtgtgtacatcgcaatatcgtactccggcagttcctcgaagaagtcgatgtggtcgcggatctccgggaaaacctcgatacgggtcttcaccatcgctgcaatcttcttcaaatccatatccttgtgaatgacctcacgcagatacggctccgccatctcataaaaacggtcaaaatccatcgccttgatgtactccccgttcatccactttaacttggtgtaatcgaacaccgccggggatttgctgattctgtgatagtcgaactctttgatcagctcatccagggtaaagatctcacggttgtcctccgggctccatcccaaaagtgcgatgtagttgaccactgcctcggacaggaatccctgctctaagagatcctcaaaggaagaatgtccgctgcgcttggaaagctttttatggttctcgtccgtaattaacggcagatgaatgtacaccggtgactcccagccgaacgcatcataaagacgctgatacttcggtgctgaggagaggtattcgtttccgcgaaccacatgtgtaatattcatcgtgtggtcatcaacaacatttgcaaagttgtaagtcgggtatccgtccgacttgattaaaatcatatcgtccagttctgcgttctccacggtgatatctccgtaaagttcgtcgtggaaggttgtcgttccctcattcggaatattctgacggatgacaaacggcttgccggcagcaagatttgcctcaatctcctccttgctaaggtgcaggcagtgcttgtcgtagagcgtgatctccttgccctcgaccacctctgtcttaagggatgccagacgctccttgtcacagaagcagtaatatgcctcccccttctcaatcagctctttagcatatttcatgtaaatgccggtcttcatacgctcgctctgtacataaggaccgtatccgccgtccttgtccggtccctcatcgtgtacaagtcccgtctcctgcagcgtgcggtagataatctcgacagcgccctccacatagcgctcctgatcggtatcctcaatgcgaagcatgaaatctcctccggcatgctttgcaattaaaaactcatataatgcggatcgcagattgccgacatgcattcttcctgtcgggcttggtgcgaatctggttctgactttactcatcttaaacctccattgtataacaccttacggtgctgtttctttcctgaataacaacagcctgtggctgtcctttgtcttgtgacatgaccacaggctattatataacaatttgatacttctggcaagcggacaaatcctgtgcctataattttttgaagacctctgtctcgcgcttcaaatctgccgcgatgtgctggttctcgtccatatggcgcgtgatgtcctccatgtcgcccacgagcacctgcgtgctgtcggcagcgctggaaacgcccttcacaccctcctcgatcgcatgtgcaatcgtgttgatggaatccgcgatctctgccatcgtcttctttaagacctccgtcttctcggtaaagtctcccatgctggtctcaatgtgggttgccttctcccggtacgcacttccggcatcgacaaacgcctcaaactccggaagaatggaatcattcatatactgcaccagtccgttggaatgttccgtgaggtttccaaccgcctccgtcacaacgcggttgatctgctggatacggttggctgcctcctggctggcggctgcaagctggctgatctccgtcgcaacaacggaaaatcctctgcccgcttcccctgctctcgctgcctcgatggaggcatttaacgccagaaggttggtctggcttgcaatatttaaaatatcatcggtcaggctgtttacctgatttacgctcttgctgtcctcgattgcctgatttaatacagttaaaatctcattgaccttggctccggtagactccatgttctcccttgcggaagcctccatggaatccgcatgttccttcatctcgcgggtgtacgcgttgatctctgacgtgcgctccgcgatctggtcaacttcctgctttacagactcggtgttcgtattgatgagggatgcattggctgacatctcctccatcgtggcagaaagttcttctgtgagtgccgacagatccgacacactgccattcgatgtcacgacgctgtcgcgcacctcgccgaccacagattccattctggttgaattgttcacgatcaccttgaaaatatcctgaagcttgtccataaacacgttgatgccgttgccgaccgccgcgacctcctggttggcgtgcacgctcacacgtctcgtcagatcgccctcgcgcttgtcaatgtcctcaataatatctgtgatctccttctgtgtctttaacagagggataattaccagctggaatacgcagatcagagttgcaagcaacgccgccacactgatgatgatggatgccgtgctcgccgcgattgccgtccggtagaccgctgcaagctgttcctttgccacatccgcattttcgctgacattggtgcggattgccgcaatgctctcctgcattgcactggaataatcggcgatcttgccgtttgccagcgcataagccgcctcgttatcgttgttggcactgtatgccatgaggttggcaagctcgtacttcattccctcgtagttggacaccagcgcatcgtattccgccttgttgtcgtctgtcacatattcctggaaatcatccagatatgtctctaaggtctcctgctcactccggatggtctcgaccagcgagatcatggtatttaagtcggtcgccacgatatgggacagtcccagtctgtggatcagaagcgtctctttctgaatatcgccgagctctgaaatacagctcatgtagccgtttgcaatctgcgttgcatttgcatttactctcttaatattggtcactgccagaatattggaaacgactgacacaaatcccaggataaataccggaatcagaataataaactttgtactgatatagctttttttcttcatatcctgctcctccccgttactgtaccgtcgactgtgtaattccagccacaagcgtatccatcacttcctgcggatccgttccgtttgtgctgcctgtcgccatcagattgccgaactccgtcgtcgcatcccagaagctgttgcccacacgctggagtttgccgtactgcgcctgcgcaatgactgcctggatggcaggcaccgcctgtacctgctccgacgcagccgcgtttttattggaaggtccctgatcgcgctcctcaagacgcagcatctggttctcctcgtttgtaaaccagtctgcaagctttaatgcccagtccttgtgcttggaataggcgttgacgcccatcatcttatagcccgtgaaagaggccatctggatctgctgtcccgcgcaggtgtaggtcggaagcttcactgccccgtaatcgttgccccatacctttttgatctccgatgcattccacacgccgctgacgcctgccacaaccgttccgtcctgcacgccctccatgaattccgtgtcggtacagcttaaaaacgccggattctgtgcgatggcaagcagcgcctcctcaatgtcggttccctttatgctgccttccgtcgcattccagtcgcagtagttcgtcaccccgtcgtcatttacaccgaaatccagtccggtgttgccgaaaaacgcatagaggtaccagccggaactccagtccatcgtcaccttcttgcccacagcgcccgctgctgccagaagcccgtccatcgtctggacgtcctcttccgtcaggtaattcttgtcgtaatacagaaaatatccgttgtccgccgtcatcgggtaagcgtacagcgtatcattcacagaagccgctgcaaccgcctcatccagattcgcctcccggatctcatctgcatttggtaccggctctaaggcaccggctgcaaccatgctggtaagctgatcgtccggcagcgggaagacatccgctccgttatgtacatctccaagcagcgtattgcgcgtctcagcatctgcattctccgcaagctgaatatcaaaatctgcctgtcctgcatatttctgctcgaagctgtcgatcatctcctgcagaacatcaaaattggcctcctctgcccatacggtcaatgtaaccttgccgtcatcctccgctacatcgccggacaactctgtcgaatccatgaccgcctccgtctgcaatacggacggttcaccgtttacggactctccacctgccgtcgtatccgcacctgtacagcccgccattgctgttgtaacaaaggctgccgctgcaaccgccgcaataacatgcttcttcatttgaaatccccttcctttgtattcgtatctgtatgtgcaaattctctctgccgcctcttctgttcttatacacgattttgcactcattttatatattttacacctattttacaaaatgcgcaatcggttgttccttttttttaatttttcttatcctttctcccacttttacatccgctgcaggatgagcagtgaccacagcagccacaatcttctttgtctttttttctttttcccatatacaaaagcgccaggatgatccacaaaaggatacaccccagcacaatcagatccaacgcatgcaacccactcaaaagaagattcctcctatctgataaaccgcaaatgccatcagccacgcgaccgcgcattgaagcaccacgacgagaaatgcccgcatgccgcttcccatctcacgcttcaccgccgcaatggctgcaacacacggcgtgtaaagcagcgtaaacacaaggaagcttgccgccgagcgcccggtaaacatacttccgagcaccctgcttagattggcagtcgccgtgccggtcaacacactcaaggtgctgaccaccgcctcttttgccgtaaatccggtaatcaacgccgtagaaaccctccagtccgaaaaaccgagcggtccaaacagcggtgcgatccactgccccaccagagcgagcagacttttctcactgtctgtcaccacattaagcttcagatcaaaggtctgcaagaaccagatgacaatcgttgcaacaaagataatggtaaacgcgcgctccaggaaatcctttgccttatcccagatcagctgtccgacactctttgccgacgggaaacggtaattcggcagttccatgacaaacggaatcggattcccgcggaacgcggtgtggttcagtaccagtgcggacaaaatgcccaccacaattcccgccgtgtagagaagtatcatcacaaccgcctcgttccccgggaaaaatgccgccgcaaacactgcatagatcggtattttggcagaacagctcatataaggcgtgagcataattgtcatctttctatctctctcactcgacaacgtccttgtcgccatgaccgccggaaccgtacagccgaatccgatcagcatcggtacgaagcttcgcccggaaagtccgatcttacgcagcggcttgtccatcacgaaagccacgcgcgccatgtagccggagtcctccagaatcgagaggaagaagaacagcaccacgatgatcggcaggaagcttaacacgctcccgacgccggcaaaaacaccgtcgatgagcaggctgtgtacaaccggattcaatccgtacgcggtaagccccctgtcacagacggcagtaaacgcgtcgattcccaccgccagccagtcgctcaacgccgcgccgaccacatggaacgtcagccagaaaattaaaaacatgatcagtagaaacatcgggatcgcaaggtacttgttcgtgagcacaccgtcgattttcacactccggatgtgctccctgctctcctgacattttttaaccgttttttggcacaccttctctataaaggtataccgcatgtcagctaacgccgcattccgatccaatccacagtctttttccatctccgcaatactatgttccatcatttccagctcattctcagaaagagccagacgttctataatgtccgtgtcattttccacgatcttcgtcgccgcaaagcgcggggacatcccgatatttaccgcatgatcctccacctgatgcgacaccgcatgaatgcagcggtgtaccggcccctgctcgcagaaatccatgactttgggcggtatctttttgcccgcaacttccacaatcgccgcaatcagatcctcaattccctcatccttcgccgcactgatcggaatcacgggaatccctaattcctgcgacatctgcctgtaatcaatggaacctccgtttccgcggacctcatccatcatattgagtgctaacaccatcggaatgtgcatttccagaagctggagcgtcaggtaaagatttctctcgatgttcgtcgcatccacaatgttgatgattccatccggcttctcatttaagataaaatctctggtgacaatctcctcattggtataaggtctgatggaatagattccggggagatctaccacggaacaattcttcgtggagcggatttcccccatcttctgatccaccgtaacgccggggaaattgccgacatgctggttagctcctgtcagctgattaaacaacgtcgtcttaccgcagttctggtttccagccaatgcaaatatcatttttcttcctccggtttcacttcaattttcgctgcgtcctcccgccggatcgtaagctcatacccgcggatgcgtatttcaatcggatctcccatcggagccaccttgcgcacctccacagcagtcttcgggatcagtcccatatctaacagccggcaccgcagtgtgccctctccgccgaccgcagtaatagcagcgcgctttccgattggcagttcctctaatgtcatattttccacacaccttttctcttttgatattgatattcattctcacttatactaatatgatgcttctgcattgtcaaccggcattccggtgtaatggaattttttgtttcagggaacactaaaaggaattgctgcaataagcacagctctctttggggtgataagtaatattataaagaaacgcacttggggatttcatgtggaaatgcagagggaatattcgttggaaaaaaatgtgagcatttcttccagctgaatgtttgcatcagattccgtgtctcttccacgttttgacaatccgccgggtgcatgtccgacacaccagagacaatgggcggactttctggtgtccctaagggcacctcttcacagacaatataaaaccgcgcgaaccgaaactcactgccatctgctattaaaaacatggcagatggcaattcagacatcggcttcgcgcggttatgttttgctcagaggtgcccataagggacacacacaaaagtcctacaaattgtcttccgggatgcggacatgacccgcggagtgctccaaacttggaaagacacggatcatcgaagatgcaaacatccggctggttagaaataccacattttttgaaccgaattttcctctgcattttcatctgaaatcccactgtgtaatcttctgatcatattacttatcaaacccaagtacgatatgcttattgcggcagttccttttattttccgcatcccggatcaaattcgggattacacatataaaagttactgcggtcgagatcgtcctgaatcatccgcaatccctcgccgaagcgctggaagtggacaatctcccgctgacgtaaaaagcggatcgggtcgcagacctccggatccttgaccagacgcagaatattgtcgtaggtcgtgcgcgctttctgctccgccgccatatcttcaaacagatcggtgatcgcatcgcccttagactggaactcgcacgcattgaacggaatgcctcccgccgcctgcggccagatacccgccgtgtgatccacatagtaaggcgcaaaccccgcctcctccagttcctccgcactcagtcctttcgtgagctgacggacgatggaagcaaccatctcaagatgtgccagctcctctgtgccaatatcggtcagcagccccgccaccttccgatccggcatgctgtagcgctgcgacaggtaacgaaacgatgctgccgcttctccgtccgggccgccgtactgcgacaaaatgatctgcgcgatcttcgcattggggcttgtgatgttgaccgggtactgcaggcgtctctcataattccacattagcagccacctccttcccacggcaggggctgttttgcccaatcccagtaagcatctggatttgccgtatcaatcgtcagcggtccgaatttgtccgcatacacctgcatggcatttctgtgcatttctatatgatgattgaagtaacagatcgcttccgcatcgacgggatgcgtatcaagatactccgcgatgtccaccacggcaaagctcaccatattgatccagtgcagaagctgcgcctggttcatctgtgtcatctgattcatcagcaacgcctgcacccccttcccactgccagaaacggcttatcaagttctgggaatatggttccggtttcaagtgccttatccagttcgtaggtcgttttaaagtgctgccagggaacatatgccatcgcaaccacatattccggctgtctatcagaagctgcatccggttcacacgcacatcggctgcgcgtgtttcctgctgcattgtaatttctcatgcggctctcctattatgatatcttccctttactctatgccgcatcccattcacttgtgctaatctccctcgttaattttatctactgcatttaaaatcttctccatctgggggcgcatgcttccgaccttgtctaaaagctgttctgcctcctctttctgctcgttgacctgcgagagattgttctcaatccgtgcgcgcagcttctgtctgcgcccgatcagtccgtgcttgatctccaccatctccttgggatcgacgagcgcaactgcttgtgttacccacacatgcgcatcgtacagttgataattggagagcatgcgcaccagtctgccgttaaaatattccagatcctcattggttctctgatatttctggcgttccttgaccgcctccagataatactgccactggttttccagttctccagcactttttacatggtatttttcacacgcataatcgaccgcattggcaacattgatatatttcagcttgaccttgttaagcagaacaatcgcacggttctggctccgctccgccacctgtatctccgacaggtcattctggattttcatgtaaataccgcacaccaccaccgcagttgcaaagatcagtcccatccacgcatagtagaaatccttttccagaataatctgtaaaattccgaacaccaccgcgagcgtcaccgccagaccgacaataatatacagcacattttttaactttttctgctgatggtccaggtattccttgcgcagattccactcggacttttcccgctccagatacttcatatccctctgcagcgtgtcacggtgcagttcgttggtcttaaaacgtttgattgcctccggcagttcgcgttcctgctgctctaactgtgtaaactgcgcgtccgacaacttcttggaggagttgagaaattccgtgcgcgccttgtttaactgcaccacatttaccgcgatctcagaaatcttatctctttcttccttcggtatcttctccagagtctcaatatcgttcagataggacgtcacaatccggtattcttccttctcatcgtccagctccttggtcaactcaatcatctgctctaggcgctccaccacgtactgttcaatcttaccggtatttttgtaatccttttttgagagaaccgttgtatttaattctcccatcttactctcaaaatcaggttcctttttctttctcttccaaaaaaacatcgtttcacgcttcctctatattctgcaatttttccgataggtatctttccactctgcaagcattcctgcaatttcatcttcctgcccgtcggcaaacagtccgtccacctgctcttcaaactgacggatctcctccgtccgggaaagctcggaaagtctgtgcgccgcctccgccgcctcctctgccgtcatgccgcattccgccgccgtattcttgaatccgtcatcatcgtgcagacaccggtacgcatagagacattcgcggagagattccggattttcattgagtccgtacgccttccggtaacagtccgctgcttcccgaaaccggaataatccagtatacgcttttcccatgttatgccagacattcccgaccaggatcggattctccgcttcctgatccgcaagcaatgccctgtacgccgagacggctgccgcatagcgcccgtttgtcacatagcggtcagcgcggatcttgctgcactcgtattcggatttgtgttccagctccgcgatctgctgcgcaatctgcgcgatctgcattctgtcacaatacccgctctgcgacagcagacaggtcacaaactcggacagggtgccgccttttctcacaatctcccgaagggcatctgcagcatcttttagtttcagttcccgttccagccagttgcagagatcctcattcataaaatcactgcggagcagatagacattgtggcagatataataacttaattcctccagcgagtaaacgccgattgccgcctcctccacataatatggaaatgccgccatattctgattgcacagaatcaattctcccatcgtcttctcccacacctctacggattctcttccgaaaattccatccggtaatcccacactttatccgaactcttaaataattccccgaatccaagatcccggatctggatccagacctttgtatccgaaaccggttttgccgtgatgcgaagcctcgttgccttgtccgggcgttccggcagatccagaagctttagcttctccaccttcgcctcccgggttcccggcggctgcagccagaaatcaatctccggcgttcccgcaaggatcacttcgcacattccctgcgtctcgtaccagttgtcccctgcactgatcagcgtatagaactctgcttttcccatattccggacttttaagctgacattgactttcatctcattgtcacccagatatacataatcccagttttcctgctgttcactgcacaaggcggcgtagcaggcccccttggagtacagattcttcccgacaaacgctctcctgccctgacacagaaacgccacggactgtttcatccagtccccgtcaaatccgtctcccgtcaggtacaccgacgagacaatatgtccgcggaagcagtcctttagaatgccaagaaaattctcgtcccggctgtccgcattcatccggcgcacttcctccgccagcgagatcagctgcggcgtcgtgcgtttttccttatataatctgcagcagcggatatcctccctgcggtaatcgaacagatacacgtcgtgcatcgaaagttccggcacctgatggtaggcaaaatagtaaaaacattctttccggtcaagcagctgcagcttttcccggtcaattccaagcttcggcgccatcgaaaggaacagctccgtcgcctcccgcgacagcttttccatacagatgaccagccgttccggctcccatcttctgtcggggccgcatgccagtcgtatcagttttttcagatagagggtcagcagttcctccgccggataggtctccccatccacaaaaaccttctcaccgccgaccgcccgcgagagaagtctgccgttcgcctcctcgccctgtgcaatggcaagccgcactgcctcctcgccgacaaaccactgcccgattcctttcttcttggtaatcagcgccggaatctgatagatttcgctccctgcaatcgcagaaaaggtctccggttctttcttattcaattcatagctgctgatcacagcgtactggtcatccagatcgattcccagataaaaccggtgttccatatgttcccctctctgtgctacaatagccggtatgcctcttccgtcacttttgtcatgccataatagcgcttcatcttcccggcaagcttctctctgtcatcgagcgtacacgccagcagcatctcattcagccatgcgtagcggtccccgctgccctcttccataatatccccgttgcccaggcagccgctcgccccgatctgcccgtccgcggtctggctctccaggatataatactgaaccttctccccgaagaacaggataaagtcttttacatagattccgtcatacatttccgtcaattcatccgcaagatattcctgctgtgcctccagccggtaatgaacctcgatctgctgccccggcgcggtgtgatattccagaaagaacttatctgtaagctgatatttgcgcagcagcttttcgtcgaacttccggaaaaatgcaaaatacagattatgccggatgcaggtgtcaagaagctcgtccgcgatctttctgtcacgctccgacaggtgattctccgagagatattttagcagtgcaagccggcagacgcggtttagatcgcccccggtcagataacgctccctgatctggcggaacacatgctccggcacgacggcgtcctccgtgagatacatattggcaaaataagagagatacgccatgcagaccagatctctgccgccccctgcgcaataactttcgtagatctcttccatatgcggcgtgtaatcggtcgtatagagcatctgtgtcagaatccgctcttccagatcaaacgtgtcgatctgaaattcgcccgcagctttccacaattccgccatctgcttggtcggcccattaaaatacttgcagaggtaaatcagcatgacatcgctgtattttccctgccggaaggtgctctccgcaaatcccagcagaaaatcatcctcctcatagccgtgatccgcgatcgcatagctgcagagggagacgcgccactccgtcttcagataatcgtagccgtcgatctgcaccatctgataggccttctcatagaggtggttctccgtcagaagcgcggccatctgcctgcgcacactcacgtcggaaagtgcctccgcgagctgccccttcatcagatccagttccccctccgaataggaaaaatccctgccgtcttttttctcgtaagaaatcagcgcaagtgcaagccggacgagataggttctggaaagtctgcctgactgcagcagctgcaatgcataggtcttctcggtatcgctccatgcctccggctccatatgcctgctcatataccagagcagataggcgttctcccccggtgcaagcgagagacactgacccacataccgctccggatacatcagcgcctcatcctggtataccacactcgaacagaaccggttgccgttcgtatcttccagcacaatgctatactgtggcgtatacgccttaaaataggcggttccgttcacaaacgacacgctctgcggcattttcatctcctcatgccagatgatggctcgggcgatctgacggttggtgcagctgattctgtgtgtgaacaaaagcggcgccagactgtgtgccagttcttcatccagtatacccttgggcagcatctcatcgtagatcaccgccagatgatcgttgatgtgccccgcctcgatctgtgccattgcaaactgctccatcgtgcgctgatatttctggtatacctccggctgtttcgttctggctgctatgatattgacaaacaagaccgccttctgcgtataggaaagcgtactgtcatactggaaatacatctgaatcatgcgcggaactccgcccacctcacgcgcatccagcgacatcagatacgcctcatagagtcctgtaagccttatcttctgctcgattccgagctcataccaccggtggtactcggtttcgtaacactgtgtgcggatcagatatgcacagatggcagaaagcatctcctcctccggctccacctgatacgccgcctctaagatctcgtacagtacccgcgacttctcacgcacctccggcagcagatgcctgatctgctgtgcaagttcctttgtgaggactccctggcgcatcgcccaccgcaggactttcaattcatacgttcccagtctggttaaaagatagggatcctgccagatcagataatagctttccagatagagatacgggctgctgcatccgccctcgatccatgcttcaatcgccttatactttcttggactgctgtaatagtaggattcccgcaaaaacaaaagaatccagaacaacagcgaactcttcggattcttcttaaaaaggagttcaatctcatccgtcagcttatcgacataggacggttccctctcaatcagtgtgcacagatacagatagtatccccattccggcgtctccctgtccctgcagccgcgcttataatcctccataatccacgaagcttcctgcttctgccggttcacaatcaacgcctgcgctttcatcagcgcatacatctcacactccggttccattgccatcatatgatccaggagctccacggactgattcgcccatgcgccggtcacaatctttttcagccggtaatcaatatatagctgtgcaagccgcatccgtccgcgctgtaattccagatgctcctccgatacggcttttgcgccgtccgtcgtggcgcacacttcaaacgtaagcgtctgctccggcaggacaatcgaaagtcttccaaaattcttcccggcatgcatggcagcttttttcacataatatggcacttccagtgtgcttccgataaaatcctcatccgtcagctgactcttttccggcaaaagaaacggcgcgtccgactcaatcgaaatggagagatagccccactcatcccggtgcagcttcaggctctccctgcggtcgccggcgacctgctcgaatgaggcatgatccgcaagaagcgtaaccgcaaccggctttttctgtctgcacccgcgcagatattcctccaccttctgccatgacgccgtgccgtccgcctccccgtcatagagaagacgctccctgacctcggagggctttagtatatttttaaaatgaccggaataaaacagatgatatgcctcttgggcactgctttttgccagtcccgtaaaatcgttcagattcttaatgcgtcccgcagaagtatccgcatacaatctggatacagacacaacaaaagaaaggttatattctccctggttgcagattagaaaaaaatcccccttgacaatatccccttcgatcagtccattgctatgaaattggtaccggatccgcacctcttccccctcaaactggggtgtcagacattccattctggaatcagaagtatagactactccccgaaacggcacatggttcgtacttgtgataatgaaatctccggtgtaatctctaccctccgtcacctcaatgtcgactttatctgcagaaaaagaaagaagcggtctggcgtattggaactttccccttgctagctgttgtatccgtttacgcaaattgacacctgcttttctattgcttttttgaacgcaatgactataatagattataaactaatttggaggagtaatcaatgataaaacacaaggaccattttcatggaagtgatctcgagaaaatagaagaaatctacggcattaaaaaggaagaaattgtcagtttttccgccaatgtcaatccgttaggagtatctccgctgttaaaacacacgctgtccgatcagatcgacgccattaccagctatccggacagggagtacacttctctgcgcagatgcatcgctgcatactgcggaaccgagactgagaatgtcattgtcggaaacggctccaccgagctgatctccctttttattcaggtcgagcatccgaaaaaggcccttgtcattggtcctacttactctgagtacgaacgtgaaatcgcgctgggcggcggcaccacactctattatccgctgcgggaagccgatgacttcaagctcaatgtcgaggattttctctcgcacttaaatgagagcattgatcttctcgtcatctgcaatcccaacaacccgacttcctcctcgatcccgcgcagcgacatgcgccacatcttagacgtctgcaagcagtacgacatctatgtcatggtagatgagacttacgtggaattcgccgataatatggcagaactcacggcagttccgctgacaaattattataacaacatcgtgattctccgcggcacctccaagttctttgccgctccgggactgcgtctcggatacgccgtcacaggcaaccgcgatctgatcaagtccatcaatacacgcaagaatccgtggacgatcaattctcttgctgtcatcgccggtgagacaatgttcaccgacagcgcctacatcaaagagaccaaatcgttgatctcctccgagcgcgcccgcctgtgtaagctttttaataagaatccggacttcaaagtatacgatccaagtgccaactttgttctggtgcgcatcctgcgcgaagatctcacctcgcaggatctgtttgaccgcgccatccggcagaaaatgatgatccgcgactgttcgacgtttccgtttctggataataaatacatccggctctgctttatgaagccagaggacaacgaccgtctgatccgttgtctcttccattagaattaaagagaagcgggatctgtaatattggaggaaagcagataactggaagttccggatagaacagacggcggcaattctgaccgcaaaatccggtatttctaaccatgccgcgcttggcatcttcgatgatccatgtctttccaagcttggagcactccacggactgtgtccgcaagccggcagacaattttaggacttttgtgtgtgtcccttatggccacctctgaacaaaacataaccgcgcgaagccgctgtctgagtcggcatctgccctgttttcaatagcagatgccggcgagttcggttcgcgcggttttatattgtctgtgaagaggtgccattagggacaccaaaaagtccgctcattgtctgcggctcgtcggacacactctgtgagtgtccaaacgtggaagagacacggaattggatgtcaagcacggcatggaagaaatacatgaattttgcttcaaagaattgccgccgtctgttctattccggaactttcggttctcgggtaatctcacaatatcatggatcccgcttttctttttatgtaaactgcttcatctcgtcagttctgcctcggatcgttccgatggccccctttacttcctccgcatagttccggttctgctcgcttatctcacgcacctgctcggcgcttgcagtcacttcctctgtcgctgcagacagctgtgagatattctccacaatacggttgttggaatccgacagtcctgtgatctgtcccgcgatctcattgatatctcctataagctgtgacatattttcattcagacgttcaaaagactctgccgcaaccgcaatcttctcattctggctctctgtcgcttccaccgaagactccaccgaagtcataacgtcgcgtgcattttcattcagctcgttgatgatcgtggtaatctcctccgtggacttcttcgtctgctcggcaagctgtctgatctgttcagcaaccacggcaaatccgcgtcctgcctcaccggctctcgcactctcaatggatgcgttgagtgccagcaggttcgtctggttggagatattgaggatcatgcctgcgatctcctcgacctccttggtcttattctgcaggcgtgtcatggactccgtcacttcatgattcgtcgccgcaatctgctcggactggttcttcaattcttccattacctgcagattctcctgaatattctcattggaatccgtcgccacatccaccatctttctggagcgctcgcccgtctcgtcaatagccgactggatactctgtgtcatattattctgctcttcgatattcttcgccgtcgtgttggttgcggaagaaatctcctgcatgctctgcgcaactgtctccgaagtgtgcaccagttcatccacaagactggtactcctctcagactcatcccgcacagtctttgagatgtcaaggattccttccagcatcaccttctgtttctcaccctcggacgctgcagaacccagtgcatgatcgctgaatgtcttggctatgctgcccacccggtacataatgaaaaataacagatacacacataatacccggcacaagctgtccacatcctgcaaaccaatccccttgattacacgaatgacctccaccagtgtaaataacgccgtaaaagcgatacaggtctgtttatatctcttcatatcataatacggaatctgcaatgtcagaatggcaataagtgcaaaatagataaactctgcatctgtctgcattccaatcaacgcaaattctacgccgacaccgatggcaacaaccctctttaatctcacatcagacttattgcgcagataaaacgccagttcaaccaccgcaaataaaataatcagcacaacatttccgaccgccgtaccgaccgcaatgctcttgctcgcaagcttcgccagcagatacaccccaaacagtacccataaaataaccactgcaaaaatataaaatgtattcatatagcggtagcgttcactcttatctttataaatgtaattcctgtctgaacccgatgtctgacccatagtcttactccctcctgtcactctttctctatcgattcaaaatctttttttattatagttcatttctcctattttttctactgtttttcaattattttgactaattttttacacattccttatcctcgcgcaacacaacgcatccgcttcttttccgtaagctgcggcgggttgctccagcgacataattctactccgacgcagtgagatcctgccgaagggctttttcattcataggacgtaatttcctatgaaaaaatccggcggatacttccgccggatctctcatccccactctttttcatatgccgtatacaaaaactccacgcagccgtctacgcggtacagcctgaaattctgtaaaaacaaaagtgccgcctcgtacattttttcatcctgctcgtccgcaaggcttccctcaagcagataactcatgccgttgtggtattcccgtccgtcctgtatcgtgtagtggcgccacagttcttttcgttgcgcacatgcggtctgctcccgcataagcgtctccagaaactgtacgcacggtctttctgcctcgctgtaatgattccggtacagatacacaaaatggtgcggcggttcgattccggaattcttcaagccatactggttgaccggataattgtccttctgctgcacccagccaaacaccccgtgaaatgtcaatccgccaaccgccgcaaactgcgtcctctgctctaattcctccggggaggataccttctctcccagttccgctgcaattcttccggcaaccacaaaaagccgtctgtgcatctgtgcacagcggtaaaaataccaagcgtcatagtacgtcgtgccggaccagttcaagccgcagcgcgccgtcaggcgctttcccgctctctccatggaaaatacactcatccgcgcattggcacgcaggaaaaattcaaggacagtctccgtgatttgcggctccgtcttcctgccggtgccgcctcccgtgtccttacacttctggcagcacaggccaaacagttctcccacaccgtcctcgtccagctttttttcgtgatagtcccgcaggatggcattggcaatctgatagagaatgttggctttccactttcccaccatgcgcacgatccccatgatatcctcataggattcacaccagagttcctccggatcctccgaatgttcaaaggtgtctcttccggggcggatccagctctcgccgtcgactgccggtctggctttttcgctttccgcctcccgctccttcgcctctttgagcagagactccagaaagagaacgctccacttttttctgccggtcttctccggaatccggtctgctgcgctgaccttttttgtcttcacccgctctgcttccattcctaacctttcgcattgtagcggctgccggtctgccgcgtctgattactgtccgacgcatagcggctgtaattgccgctggtcatataagaagttgcagaaagcgctgccgcctgttttctacagttgctcttcacacccgaagccagcacctgcacgcggttcgacagcgtgctcttatccccgaaaatcttctgcaccgcctccggttttactgtctgaaacaccgtcttatcaaacgacagcgtgccgtctttctccagcgtgattccgatctgttttaaggcggtctcccgcgcggaaatctccgttttcagcttctttgcatacgtctcgtccacactgtccgacaagtcaccaatcttgcggatcatcatattgtaatcggatacaaaactttccatttccttcgtaagctgctttccggcgtcctctccctcctggtaaagggatttttctccctcctccagaaaacgcttcatatgcgtctccacacgctccgccgccagtcccgtgatctcataatcgtagctttttttctgattctccacgattttgtcgccggatacggctgtcccgttttgaaactgatttaaaaactgcatccacgcagatgtcctgtagtttttactctttggcgcgctctgcgtcgttcctttggatgatgcgcgtgtctttgtgctgctggaaaacgcacgcatctttgccagccggttgttcctcgcacccagaatggcagactggtctctgttataaattctcatactcattttccccgtttcttttctgtatccctatcgttcgttaagatacgtctcataagccgacgcaaaatcattaaacttctgtttcgccatcagaatggactccccgttcttcagcaggatcgttcccacctcaaaactttttaccgcggcaaaattcaccagatacccgcgatggcagcggaaaaacccgttgcctaaaatttcttccacctccttcattctggcataatatgcaatgattcccgtgtttgtgtgaagcaccaccttacgccccacactctctgcatagagaatggttttctgatccacacagcaataggttccgtctgttttaatcagcagcgggcgcttcctttctgcccctgcttttctctgtttcagttctcccgcattgtcaaacgcttttctgcggaaccatactggaatctttttctggcactcctctatgccactatccgaaaggaaaagaacatccggcattgtgccgcttccctcaatttcatctccgcaaagaatctgtacatcctctcttacatattcgccttccatctcttttaaatacttacgcacggatgcctcattcccgcacgccgcaatgtataacactcatattcctccccgctttcgcatccatgctctgttttctactttatatatcggtcatatttttcattcttttatttttcgtaacgaaatacgctgtttttgtcatcaaaaaacagttgacacgcttactgtattattgtattatcttattagtacagatgatttagtagaaaggagatgacactatggcatggacccttgattctgatcgtcccatctttttacagattgtggaacgaatccagacggacatcgtttccggccgctaccagccgggagataagcttccgtctgtacgtgatctcgcagcggaagcatccgtcaacccgaacaccatgcaaaaggcctttgcagaacttgaacgcaccggtctggtctattccaggcggaccagcggacgttttatcacggaggattgtcatatgatagaacagttaaaaacctctctcgctaccaagaaaatggaagaatttttagcacagatgcggcagctcggctttcagaatgatgaaatcctgtcgctcatgaatcagacgatgaaaggggaaaaacaatgagtaccttgttggaatgtaaagatctgaccaaatgttacggcaaaaaaaccgccatcgaccatatcaacctcgccattgagagcggacatatcatcggtctgctcggaccgaacggaagcggcaaaaccactctgatcaagatgatcaacggtctgcttgcccccacctccggttccatcttcatgcagcagaatccgatcggcgcagagagtaagaagcatatctcctacctgccggatcacacttatctgaatatgaacgagcgggttcgcgatattatccggtatttttccgatttctatgaagattttgatgagaagcgtgcctacgacatgttgggaaaacttcagattgacgcctcggatcgtttgaagaccatgtccaagggaaccaaagaaaaagtgcagctgattctcgtaatgagccgtcatgcggatctgtatattttagatgagccgatcgcaggcgtcgatccggcagcacgcgattttattttaaatatcattctgtcgaattacgaaccggaagcttccattttgatctcgacgcatctgatcgccgacatcgagaatattctggatgaagtcatcttcatcgatcacggtcagatccggctcaccgcatccgtggatgatatccgtatgaacaacggtaagtccgtcgatgcacttttcagggaggtatacagatgttaaaaaaattatttaaatatgaatttaagagcacggcaaagatcatgttgatcctgtacgccattctgatcatcaccacctccgtaggttccgtggtgctgtattccttagatctggatcaggcgggtgaaagcaaactggcatccattctatccgtctccgcgattgtcctttatatccttgtcatttttgctgtccttatcgtgatgtacgtgtacctgtgtgtccacttctaccgcacgatgtattccgctcagggatatctgacacacacgctcccggtaaaaacacttgctccctttcacgtaaaactgataacctccttcgtgtggatgtttctctccatggctctgatgactgcctccatcgtggcgcttatcgccagcgcctcccacggaaccgcatggcaggattttacttccgcctgggaggagttattcggtcaggacgtattttccttccatttcatcttccagatggtattgggcgtaatctgctcctgcttaacctacctgctctgggtgtttgcaagcgcttcgatcggacagcttttctccagcaataaagtggctgcctccctcgttgcaggcatcgtcctctattttatgcagcagattttctccatgatcctcatgtttggaaccggtatgttccagtcgggagataattccgtgaatttctttgccgttaccacaacgatcgacaatacgaccacatcgacggcaagtatcctgccgagttcactgtttgtcaccagcaacatttactcgatcatcgtcattgtcattttgtaccttgtgtgcgcgagaatcatcacaaagcatctgaatctcgaataacgttctatcaggggctgccacttaagaccggcaacgcctctggatgtgataagtaatattatcagaagatcacaccgtgggatttcagatggaaatgtagatgggatattcgttggagaaaaatgtgagtatttcttccagctgaatgtttgcatcgaattccgtgtctcttccacgtttggacactcacggagtgtgtccgacaagtcgcagacaatgagcggactttctggtgtccctaatggcacctcttcatagacaatataaaaccgcgcgaaccgaaactcgccggcatctgctattgaaaatatggcagatgccggctcaaacatcggcttcgcgcggttatgttttattcagaggtgccaataagggacacgcacaaaagtcctaaaattgtctgctgacttgcggacacagtccgtagagtgctccaaacttagaaagacacggatcatcgcggatgcaaacattctgttggttagaaattccacattttttgaaccgaatttccatctgcatttccacatgaaatccccaagtgtgcctcttataatattacttatctaatatttcttatgcatgaaaggaggctgccactcatgtgacagccccttcccgaatctattacgtatttattttgtgttcaagtatgcgtcaattcccttcgcagccgcttttcctgcacccattgccaggatgaccgttgcagctcctgtcacggcatctccgccggcaaatacaccgctcttggaggtagcgccgttttcttcctctgccacgatacactttctgcggttcgtctcaagtccctttgtcgtggaggagatcagcggattcggagaagttccaagcgacatgatgaccgtgtccgcctcaatctcatactcagaccccggaatctccaccggacttcttctgccggaggcatccggctcgccaagttccatcttgatgactcttgcgccttttacacagccgttctcatccactaaaagctccgtcggattctgtaacaggtcaaaaataatgccctcctcctttgcatgatgcacctcttccttacgcgccggaagttcttcctcaccgcgccggtacacgacatgtacttccgcaccaagacgcttagccgttctcgcagcgtccattgccacgttaccgccgccgacaacgatcactttctttcccgccttgatcggagtatcgtactcctctaaaaatgccttcatgaggttgtttctcgtcaaaaattcatttgccgaaaatacgcccattgcctgctcgcccggaatacccataaaacgcggaagacccgcgccggaaccgataaataccgcctcaaatccctcgttctccatcagctcatcgatcgtgacggatttgccgatgacaacgttcgtctcaatcttcacgccgagcgccttgacattctccacttccgctgcaacgaccttctgcttcggcagacggaattccggaataccatagacaagcacgccgcccgcctcatgcagcgcttcaaaaatggtcacgtcatagcccaattttgccagatcaccggcacaggtaagtcctgcagggccggaaccgatgacagccaccttatgaccgttcaacttctctgccttcttcggcttgatgccatgctctctcgcccagtctgctacaaaacgctccagcttgccgatcgcaaccgcctcgcccttgatgccgcggatacactttccttcacactggttctcctgcggacatacacgtccgcatactgccggaagtgcggatgactcactgataatgtggtaagcctcctcaaaattgccctcttttacctgcgcgataaacgccggaatattgatggataccggacagcccttcatgcactgtgcatttttgcagtttaagcagcgcgttgcctccgccattgcctcctcggcattatatcccaaacatacctcctcaaagttcgctgctcgcacctgtgggtcctgctcacgaaccggtactcttgtcattacgtccataggaacctccatactctgtattttctatccggcagacgcactcattctctctgcctccgccttctaacgatcacatctgccttctcagccgcactgtccgcagccgccgtgatgggtatctccctccgtcagctttaacatcgctctgccctcttctgtcttatattgctgctggcgcttcatcgcctggtcgaaatccaccagatgtccgtcgaattccggtccgtccacgcaggcgaacttcacttcgtcgccgacaaccagacggcatgcgccgcacattccggtaccgtccaccatgatcgggttcatggaaaccaccgtcggaattcccagttcctttgtcagcttacagacaaacttcatcataatcatcgggccgattgccacacaatgatcatagcgcacgccctgatcccagagttcctgcagctgcgccgtgccggttccgtgaaagccgtaagagccgtcatccgtcgtcacatagagattcgctgccactgcccgcatctcatcctcaagaatcagaagatccttattgcgggatcccataatcacatcacagtccacaccatgctcatgcagccactttacctgcggatacaccggtgcggtaccgacgccgcccgcgatgaacacaatctttttcttcttcagttcctcgatatcctcatctatcagatcagaaggacatccaagcggtcccacgaaatctgcgaacgcatccccctgctccaaggataccatgcgctgtgtggaagctcccaccgtctgaaatacgatcgtgatcgtaccggcttccctgttataatcacagattgtgagtggaatacgctccccctgctcatcaatcttgacaatgacaaactgtcccggttcgcaatactgtgcaacacgcggtgccttgacatccatcagatagatcttgtctgccagcttttcttttttaacaatcggatacataatttcctcctcgccctttgtactatcttaatataataaaggaaaagcccctacatttcaacggcttttcccatattttctgtttatatctgctattccgacttcgtttcggactgtatgtgacgttttttctccctgcgccctactcctgtgtctccactttggaaaataggatacggtcgttatcgagcgcctttcccgcgcggagcgcaaactgctccaacaagtcatccaccgacatcgccgcacgttcctctcccacaacgtccaacacaatgtttcccgcgttcatcatcaatgtccggttgccgagcgtcagcgcctggtgcatgttgtgcgtcaccatcagacaggtgatctgccgctctgccacaatctgtctggtcagatgcagcaccttctctgccgtcgccggatcgagcgctgccgtgtgctcatccagaagaagaattttcggtgtgaccatcgtcgccatgagaagtgtgagtgcctggcgctgaccgccggagagaagtcccaccggctgtttcatgcggtcttccaatcccatgtcaagcagcgccagctgctctctgaattttttcttatccgccgcgttgatcctgctgaaatatgcattccgggaggttgtcgtccgaagataggcgagcgccatgttttcctcgatcgtcatgtgcggcgccgttccctttaacggatcctgaaacagatgaccgatcactttgcttctcacatgctcctgctgataggtaatatcctccccgccgagcatgatcagaccgcggtccgggaaaaaagctccggtgattgcattgaacagggtagattttcctgcgccgttgctgccgacgatcgttgcgaaatctccggcgccaagcgtcagattgacgccgtttagggcacacttttcattgacggtgccgggattaaaggtcttgctgacatttttcataatcagcatggattctctttctgctgccatatcacgcatttcctccttttcccatccgttcttctctcagtaattccgcaatatactgctcattctccgcttttgccgcccgtttctgccggtagaacaccgcctgcttctttaggtacgggaaagcgatcgccaccgccacaataatggaggacaccagctttaagcactctgccgggacattcaggcgaagcgccaccgccacgataaaacggtatagacagcttcccagaatcacgccgatgacccgctttaacatgctgccctttccgatgatcgtctctccgataatcaggctggcgagcgcgatcgtcaccatgccggttccaaggttaatatcacaggacttctggtactgcgcgagcagtccgccggagagtcccgtcagcgcattggcgacgcacagaccgatcgtaatcatcattcccgtattgatactggatgcccgcaccatatccggattatccccggttgcccggatggaaagtccgagtctcgtatttaaaaacagagagatcaatacgccgaccagtgcgacaatcactgccgccacgatcagcttataccaggttccgccgatcgcgtcttttgcccatgtaaatacggaatcgcaggcaaacagattcaggttggaggcgaatcccatcaccgcaatattgatcgtgtaaagtccggtgttgacaatgattcctgccagaatcgactgtatgccgagtctggtctgcaaaaatgccgtcacaaaaccggaacacacaccggcagccatcgccgccaaaagtccgagtaccggatgtcctgccagcgtaaccgaagcgcacactgcacatcccagcgtaaaacatccgtccgttgacagatccgctatatttaaaatactaaatgaaatgaacagtgcaagtgcaaccagtgcatagataaatcccagttccagtgcactctgcacgatcgataaggtaatgattgatcccatattattcaaactcctctgccgttactgtctcaacaacttccgaacacatatctttaaacatggagtagtccagtccaagtgcttccgccgtctctgtattcacggtcacaattccccgctctaagttctcgatcggagttgccgccggatcggctccgtttaccagaatatcgactgccatatcggctgtctttgtaccaagctcctcataattgactccgtaaccgcagaatgctccgtttaatgcgaaggagtccgctcctgtgtagtgcgggattcccgcatcgatgaacttctcaaagatggaaagttctgccgtcatgacggtgttgtcctgcggggtaaacactgcgtctacgccctctgccaccagggcatccgctgccgcctgcacctccgcagaggtcgtaccggtcttctccacataggcgattcccttctcatcgcagtatgcctttgcgtcctcaatcgcaccaagggaagaagcctgactcttatcatagagcagtccgacctttgcggtatccggatttgccgccagcatcagatcaaaaatcgctgccgtgtcgatggcatccgacgttcctgtaatattggaacccggtgcgttcacatctgccgccagtccggcgcccaccggatccgacaccgcggaaaatacaaccggaatctgattctcctcggtcgcactctgcatcacgactgcggtcggcgtcgcaatcgggataatcagatccacatcatccgccaccagatccgctgcaatctgtgtcaggatcgactgatctgcctgcccgttgaacgtgtaatccgcataatcaaaggtaactccgagctctgctccctttgctgtgagttccgcttcaatcgctttttcaatctgatttaaggaagcatcatccacatactgtacaataccgactttatatacggttccctccgccgctgtctggtctgcctctgccttctgtgtctccgcctgcgcgtctcctcctgcctcattggtcaattccacggtcgtaccggagccggaactgcttccgcagcctgccaccgctgctgccaccatcgtcattgcaagaactgctgtcatcattttctttttcataatcatttcctcctttttcctattacataaaaaaagccgtctcaagctattgcttgagacggtaataaactaatattatcgcggtgccactcatcttgacaaaatgtccactcacttcatgcactatcatacatgccggatggataacgggtccggttcccggcggctcctacctgcgtatccactgctcaggccgccctcaaaagtccattcaacaaatccctccatactgcaatcccaccgcctgcagctctctgtgatctcggataaatgtctactactctttctcaaaggtttatcggtatgtcacttactttaatacattaacgtgtatttgtcaaccttatttttaaatttccatcagacggaacttctcgatcgtctgctccaaatcctgcgcgatattctgaagtgtctttgtgtagtccgtgatgtctgccatcgtcgtgttgacctgatctgtggatgcattgacctcttccgtcgccgctgccgactgctccgatacggatgcaatcgcctccatacgacttacgaccgtatccttgttggatgacatgtccgcattgagccggttgatgttctccatgccggcattcagctgctcaatctgcgcgataatctgacggaatacctcttccgtgcgctcgatcgctttctgctgctccgactgaagctcctcgttctcctgcatggtctcttccacctgcttggacttgtccgtaatctcggtgataatcttcttgatctcatccgttgattccttggactcatccgccagcttccggatctcgtctgcaacgaccgcaaatcccttgcccatctctccggctctcgccgcctcgatagaagcattcaaggaaagcaaattggtctgtgccgtaatatccgcaatcgcatcggaaatatagaaaatcttgtcgatgctggcaatcatctcattcatcactgcaagggacatgctcgacttctctacggtcttctgtgatttttcgatcagatccttcacgctgccgagtccctccgaactgatccggttcgtctcctcggtcatctggttgatctcgctgacacaatctctggaggactccagactgttcttgaggttgtccacctcactgcttgcctcctgcgtgctctccgcctgcttcaccgcaccgtcagccacgctcgagatcgcctccgcgacctgtcccatcgtgcttctggtatctcccgcgatctcggaaatatgatccgaagtctctaaaatatgtctggacttatcctccacctcacggatcactgtggatacatccttgaccatatcgttaaaatgcgtctccagcgcaccgaactcgtctcctctggtgaccgcaatcgtctgggtaaaatctccctctgccacagcagctgtcgcacgctcaatctttttgatctcacgcacaaggctgtacgcggtaataagcgcgatcacaataccgaagatcactccgaacgcacccgcaaataccagcgcaccgttgatcttcgcaagattgccggtgttctcgacatcgctgatgcagcccagaagaatccagcctgtcacctggtctgtcatcgcggtcaccgcacagtccatgccatctgcacgcattgtgtatacagactccagtgtgatgtcggaagcgctctcatcgcccgcttcctccagggcgctcttctgctcctccagagacttcagttctccggaaatcggcgtccagaattccagacccgtcacatttccgtccgcaaaggtatttttgtcactgtcgatcacaatattgccgtccgcatcgatcagcatggcaaatcccgtgttgagaatgcggatattcctgatataattctccagttgcgccgcatcaatatccatcgccacaacgcccattaagacatctttgtatttgacctcctgcgctacggtgaagatctgcccgcctgtctgcggatcctcataaggctgtgtgatatagctgaaaatagaatttacttttgcctttctgccctggcagttcacataccagtcttccccggacagatccacattttcctcgatggtgttcatcgccgtcttatcaccgttgtcctcgtacttcacccatccggtgatgagttttccgctggacgtcgcataatagcttcgcaccgctccctgcgttaccttgcacgccgccaccagttcatcctgcacgttggcaatatagtcatcaaactgatcctcgtactccagctgcttgatggaagtcttgcgcgtcagcagatccaccggaaggctgatcgtcttctcatacgtctgcagactgttcaacgcgctctctaacgtctgctcgcttgtgagctgcatgttgctgtttaacacattcttcgtacggctgtatgtaatcactccacagatcacaacacttcccgcaatcgccacaagaaagctcaaaatcattttcggccctaaacccaattttttcatctttttcctccgttcatactgcaatatgacactttattacttacattgtagatgtttcgcacatttttgtaaatatccggtattttctttcattgtattacattctaaacaaaaacctccctgccggcattctgccagcaaggaggttctcaaaaaaatgcccacgcactctgctcctatgaaaaataaacaagttcgtcttccggcttttctgcaggtgtaatggaaatcggatacagtaccggtccttttcccttgtactctcttgcaaactccaccttgatctgcgcggtaatatgaatccaggacttgtgcggaatcttatcctcatccggatatttgcacttaaatccgatgaaggtaatatcctccacacagcaggtcatcgcaaaacgtcccggaacaaaaatgcccttcttgagcttgtcaggattgtatacaagcgccagaaagctgactttcttcccctcgtatttcttcgggttgtccaggcagtccatataccagattgcataatccgcatctgtaatctccagttcatctcccgagatgtcaaacggcagctcctcctcgcgctcgtcgagcgatccgtccgcgcgctcatacacaagctgtgccttacggttgagcgccttgacatttctgcggtattttcccttatccgtgctgtcgtcacagcggttaaagatcacgacgtccgcctgaaacagctgttccataatcatcgtgcgcatattggcaagatacatatcaaaggtggtcgcatccacggtcgcaagggactgcaccaccatccacccgcgcggaagctccgtctcggtgagcgtatccattccccaggttccgttatattcgatgaacacctgatccggcagatatttcatattgatggcattgagaaaatcagcagtaaaatcttcctcattctccaccatcacgaggcttgcatttatttttttcaactctgcctcatcatattccacctctccgtcttcacagcagatgatcaggctctttccctgatcggcaaacccgttctccagcagcgtctccttgatcagagtcgtcttgccactgtccatgaatccggtaaataaataaatcggtatctcctgcatgttctattcctctctgtcttatctcactattaaaaggcagtcttcacagcttaagcgattccaaataactcctctaatctgtgctcgtcgatatctgttccgatcacgcacagacgtcccgtataatccggctcgccgtcacgcagctcgtactcccccggcaccatgtcaaaataaatccaggagccgttctcatcctccaccatgcccttcgcacggagaatggttccatagtcgtccgtctcgcacagagtctttaagacatcctcaatctttgccttggtaaacttatgcggcgtctcttttccccagcttgtaaacacctcatccgcatgatgatggtgatgctcatgatcgtgatcgtggcagccgcaggtacagttctcgccgtgctcgtgatgatgctcatggtcatgctcgtcgtggtcgtggtgatgctcatgatcgtgatcctcatggtcatgctcgtcatgatcgtgatgatgctcatgatcgtgatcctcgtggtcgtgatcatcatggtcgtgatgatgctcatgatcatgatcgtcgtggtcatggtgatgctcatggtcgtcatggtcgtgatgatgctcgtgctcatgctcctcggcttcttccttcgcatgctgctctgccatcagctttctctcaagagaatcctgtccctctaccacctttaaaatctgctctccacggatggaatcccacggggtcgtgatgatggcagccttatcgttgatggactgaatctgctttacgcagagctccagctgctccggcgtcgcattctggctgcggcttaacacaacagtggttgcatattcgatctggttattgaaaaactcgccgaatgccttcatctgcttgctcgcctttaatgcgtttacaaccgtgatgagcccgttcagctttacatcctcttccttctccacgtcaatcacagacttcatgacatccgagagcttgccgacgcctgacggctcgatcaggatacgatccggatgatacttgccgatcacctcatgcaggtttctgccgaaatcaccaaccagtgagcagcagatacagccggagttcatctcggtgatctgaattcccgcatcctttaaaaatcctccgtcaatgccgacctccccgaactcgttctcgatcagcaccagcttctcgcctgtgaacacttcatcaatcatcttcttgatgaaagtcgtctttccggcgcctaagaatcctgaaataatgtcaatctttgtcatatctatctcttcctttccttacaatacatcatttgttccaaaacacatatattttactcgtttttcctccattttgcaaatcatatgcatttttttcatatattttttataatatttctccggttcactgcttctgaaactgcatgtgatacagtttttcataaattcccttctttgcgaggagttcctcatgcgttccctcttcctcgatgccgttttcggtcagcacaagaatcttctcggcattcttgatcgtggaaaggcggtgtgcaatcacgaatgtggtacggtttttcgccagtttttccagggagtcctgaaccaccttttcactctcattgtcgagtgccgacgtcgcctcgtcaaagatcaggatcggcgggtttttcaaaaagacgcgcgcgattgagaggcgctgcttctgtccgccagaaagcttgatgccccgctgtccgatgtcagtctcatatccctgcggcaatgacatgataaattcatgggcattggcatttttcgccgcctcgatgacttcctccctcgtggcgtccggtcttccgtagcggatattctcatacacggttccgacaaacagatagacgtcctgctgtaccattccgatgtggtcgcgcagactctttaaggtgaggtcccgcacgtccgttccgtcgaccttcaccgccccctccgtcacatcataaaaccgcggaatcagggagcagagtgtgctttttcccgctccggacgctccgacaagcgccatgtaagagcccgccgggaccgtcagattgatatgctgcaatacctgttcagtattctcctcgtactgaaacgacacatcttcaaaagtaatatctccgcgcacatcggtaagctcttttgcatccgcccgatccttgatatccggctcgatctccatgatctcgcagaagcgctcgaaaccgctgtacccgttctgaaactgctccgtgaaatcgatcaatgtccgcacgggatcggtaaatacactgatgtagagcacaaatgtgacaagatcactgacattgaccttaccatttgcaataaggatggttccggcgagaatgacgttgacctgaatcagtgtcgtgaacgcgcccaatcccgcctgaaagcttcccatataatgatagctgttcttcttggcggacaaaaatcccgcatttcctatcttaaactttttcttctcaatctcctcgttggcaaacgactttaccacgcggatgccggagaggttatcctcaatctgcccgttgatctccgcaatcttcacacggttctggcggaacgcacgccgcatttttccgttcaggtaatacgcgtaagcaaacataaacggcaggacgatgaacgccgccagcgccagaagtgggctgatattgaccaggatcacaaacgcaccgatgatcttgatcgccgagagaataatattttccggtccgtggtgcatcagctccgtgatgtcaaacagatccgtcgtgatccggctcatcagctgcccgaccttctggttgtcatagaaagaaaaggataacttctgcagatgctcaaaaatctcggcacgcatgttgtactcgattttcgctcccattacgtgaccgtaattcgagataaagaacttgctatagcagtccgcgaccaccattgcaaacagcgcagccgcaatgattttgatctggtacataatctgcgccttatcctcgtacacgagcgtgtaggtgacatagcgtatcaccagcgggatcgcgagcgcaacggcagccgacaccgtcgcaaaaaacatatccgcccagaaaatgccgcggtatggcttatagtaagacaacatttttttgaaatttttactcattttcacactccttatctctttttcaaaagactcttctattttatctgctacgcgaaaaatgtcaagcgacacgccgcacgaactgtgctatactatacatagttacgattaccatttaaggaggcatcattatgaacccaagacaaatgcattatgaaacgcttgccggtaccatcatcaaaaatcttgccagacgccgcatggaaggctactactgcgccaccgtcgaggacgctgaaaagatggcattctctttccttaccccgggctgcacagtatctttcggcggctccatgaccctggaggataccggaatgctgaccgccctgcgccacgatccgggaatcaccctgctcgaccgcgcccaggcaaagacaccggaggagacaaaaaagatctatcacgatgctctttcttccgatttttattttatgagcaccaacgcgatcaccaaagacggcgaacttgtcaatatcgacggcaccggcaaccgtgtggcagccttaatctacggtccggaacacgtgatcgtcatggcaggcatgaataaagtggctgcaaacgtagacgaggcattaagccgtgttcatggtaccgccacaccgatgaactgcaagcgtctcggtaaaaatacgccttgttccgctaccggcgtctgttccgactgcctgtcccctgactgtatctgcaatcaggtcgtcatcacaagacgaagcggcatcgagggacgcatcaaagtcattctgatcggcgaggaacttggatactaaaatccaggtttccacccgacaaggcagaaaaaatcctgcttgccggatttccacgccgcgcatggctgcttgcgacctgaattctattacgaaaaaaagagttatcgcgaaacggtaactctttttgcatacattagttgtactttctttttcttgctgcttcagatttcttcttgcgttttacgcttggcttctcgtagtgttctctcttacgaatctcctgctgaatacctgcctttgcgcagtttcttttaaaacgacgtaaagcgctgtctaaagtctcgttttcttttacaattacactagacattatctcacacctaacctccctccagttgcgtattgtgcatattcaactgtttgggtcatattcattgcactatataagattataacacatatttttttcccgtcaactgtttttctaaaaaagcgaaaaattcagacaatttactcttcccgcagtttgaatttggtaatcagaccatccagggaatctgcctccgccgaaagttcctcactggtagcagatgtctcctcggaagctgcggaattgctttgaataacatccccaatatccttcacgccgtttgcaattctcttaacggactctgcctgctgatcggaagacacacggatatttgccacttcctgaataatatcgtcaagttccgtcaataccttgttcagggattctgccgtctgctgtgtcacggtgttgccacggtcaacctcactctgatttgcctccagaagatgtctggacgtctcagccgcctgcgcactgttctccgcaagcatacggatctgttctgcaacaaccgcaaatcctcttcctgcctctccggctctcgccgcctcgatggatgcgtttaaggaaagcaggttcgtctgggaagcaatgctctcgatctggccgatcacacttacaagctcctgggaggtgccggaaatacgctccatggcctccgtcagttcctgcatcttctgctggctgacattcgcctccatgccgacttcctttgccttgtcatgcaccacatcggtggatttactgttcgcctctacctgctcagatacggttgcgacactctccacaagatcgtcaaccgcacttgcctgctccgttgctcccttcgcaagatcctgagagctgatagctagctgctctgcgccggctgccacctgatcggaagactcgcggatctgcttaaacgtgccgctcacatcggtcaccatgctgatcagatgtgtcatgacattctcaaattcgccgacataagattccttgcaattggatcttaccgcataattgccctgtgcaaactcttccagaatatatccaagatcctcaataatcttgttcaatgtagtgaccgtcactcggaaactgtccgccagctttcccagctcatcatccgagctgtactgcacttctacatccagatttcctttggagatctcttccgctacttttgtcagctccgtcaccggatccaccactgcatccacgatcttctggctgttcctctggatcagtctcgtatcattgactgccgtaataagaaatacaataagaaccagaatcgtgtaagcgagtgaaaactgcttcggcacataagccgccgcaaaaactgcaatcgctgcaatcacaagcgtcacatacattaccacactgactctccggtaacttccttttaccttatcactcagactaccttgtcccctatctctttcgtccatccctgtcctcctgttttatcagatatgcccatatcccgatacataaaaacggcatattgccgatacctacgtaccattatacaccgtttttactatttgtagcaacaaattataaaatatttttttgaattctaaattttataaatatacgcaatcatgtatttctgtcgagtttttatgcaagctgtgcctcaagtgccgttttcgcctcggcaatggcatccggaatgcctgccggattcttaccgcctgcctgcgccatgttcggacgtccaccaccgcctccgccgactttacccgcaatgctcttgatgagattgccggcatgtgcgccgtgcgccatcgcatcgtctgtcgccatggcaaccagattgacttttccgtctgatgcagatgcaagaactatcacgccttctcccagctttccctttaactggtcgcccagatctctcagaccgttcatatcgacgccgtccacgctgacagcgaggagcttcacacccttcacttccacaacctgatccatgacatctccaagtgcttccttggctgccttgctctttaaggattcgttctcactctgaagtgcctttaactccgccatcagatgaccgatcttctcgacgagagttgctggtgttgcctttgcagccttggctgcagcctcgagttcttcctcttccttcttataatatgcaaatacattgtctccggtcagagcctcgatacggcgcacgcccgcagccacaccgctctcagagataatcttaaatacaacaatatcgccggtgttcgccacatgagtaccaccacagaactcctttgaaaaatctcccatggacacgactcttaccgtctcaccgtacttttcaccgaagagtgccatcgcgcctgtcttcttcgcttcctcgaccgtcatgacgtcggttctgacatcaatcttctcagcgatcttctcgttgacgattgcttccaccttcttaagttcttccggtgtcatcgctgcaaaatggctgaagtcaaatctggtgcgctcaccgtcctgataggaacctgcctgctctacatgtgtgccgagcacttcgcgcagcgctttctgtaacaggtgggttgcagagtggttcctgcaggtatccctgcgcagctttgcatccacactgagatctgctacatctcccgccttaatcataccgtttgtcatcttgccgatatggccgaccttaccaccacgcagcttgatggtctcttccacctgaaagataccggaggcggtgcggatctcgcccttatctccctgctgaccacccatcgtcgcatagaacggcgtcttctccacgatgatcgtgccgacctctccgtcggaaagcgcctccaccagctctgtctcggtggtgagcactgtgatctttgaagatgctgtaaggctgtcgtagcctgtgaactccgtcgtgatcgaaggatcaatctcatcgtataccgtagcatctgcgcccatgtaattcgttgctttgtgtgcatcatgtgcttttttcttctggatctccatggctttcttaaatccgtcctcgtcaatggaaaatcccttctcctccaggatctcctgcgtcagatcgagcgggaagccatacgtatcatagagcttgaatgcgttctctccggacagcgtcttctctccagctgtctgcatttccttctccatcttctctaagatggcaagaccctgatcgatggtcttggcaaacttctcctcttcctgcgtaagcactttgaagataaagtccttcttctcctcgagttccggataaccatccttgctctcatcgattaccgtcgctgcaagcttcgccatgaaagtaccaccgatgccaagcattcttccgtgtctcgctgcacggcgtatgatacggcggagcacatagccgcgaccctcatttgacggcatgataccatcggaaatcatgaatgttgcggaacggatgtgatcggtaatcagacggatggacacatcatcgagcgcatccttctggtaagactttccggacagttcacagaccttgtcgcggattgctttcatcgtatcaatgtcgaatacggaatccacatcctgcatgacaaccgcaagacgctcaagtcccataccggtatcgatattcttctgggaaagttcagtataaccacccttgccatcaccctcaaactgggtaaatacgttgttccatacttccataaagcggtcacagtcacagccgaccttgcagtccggcttaccgcagccgtatttttctccgcggtcataatagatctcggagcacggaccgcatggacctgcgccatgctcccagaaattgtcacactctccggtcttggggtcacggtagaatcttgtgatacgctctgccggcacaccgacttccttcgtccagatgtcgaacgcctcgtcatcctccccgtagatcgacggataaagtctgtcctcctccagtccgagcacctttgtcaaaaactcccaggaccatgcgatcgcttcatgcttaaaataatcaccaaaggaaaagttgccgagcatctcaaaaaaggtcagatgtcttgcagtctttcctacattctcaatatcaccggtacggatacacttctggcaggtcgtcactcttcttctcggcgggatctcctgtcctgtaaaatacggctttaacggtgccatacctgcattgattaagagcagactgttgtcattgtgcggcaccagtgaaaaactgttcattttcagatgtcccttgctctcgaaaaattccaggtacatcctgcgcaattcgttttctccgtaaaacttcttcacgacttcttcctccaacatgtttctttctattttaaatctattttgtctcttcgacgtttccggtctcaccggcattcttagcatccttgcggtcgctcaacttctttcccgcaaaaattccaagtcccgccaccacgaccaaaaccacgaaaatcagtacataatgtacaaaccatcccaaaaatgccatagtcaagtcctgcctttccccaattcttcacaccccgtgtgaaatcttctataactaaatcagtatagcgcaaccgttttatgatcgtcaagtaccgcttttttgaaattcctctcattcctcaaggatctcaaaaatctggttttcatgctttatttccacaacccgctccgccatcgcagcgttcgagatcctcttccgataatccggaagcgcgctgtaatcctgccacatatgcatcggaaatacgtaatccgcatccgtgtgctccaggaaataattcatgccgtcaaactggtgctccatcagcctcggatctgccggcacaaacgccagatgaatcttcctgccggaaagcctgcggatctggctgcggtaatttgtacgcatggatccgttgatcagatcgccggctccgtcccagtgccagtcattcagatcgccggcatggtaaaatgccgcgccgttcgtctccacgtaaaatgccacgcccgcgtccgtcgagcgcagagtctcaatattcaagtcgtcgaccctgcatttttcatccgcccccacatagtgaatccgcttcgctacctccggcgcgaatccatgctttgtcagaaagtgcgggctcatcttacagtcttttgaaaaaataaaccggatcttcggatatttttctgcgagatgcaacacatccatatcaaaatgatcccgatgcttgtggcttgcgaacacgtagacgggcgtatccggctcgtactccggcagcacaccgccaaagtgatacccctccacccggtctccatcaaaccagtcaaaaatcagcaccttctcatccacctcgaccagaaaacaactgtgatgaataaaaataacctgcataattctcctcgtttctccgcaatgtcagaagttctgccctgcaaatctaatgatttctatttcatgcggccgatgatcgcattcgcacgctgatagatctctttcggatcaaacccgatctcgaaatgattgtcttcatagagaactttgccgttaatcatcgtcatcttgacattctgcttgctgccgctgtataccagattcttcacgatattgttttccggctgcatgttcggctggttcaggtcaatcatgacaatatccgcctttttgcccaccgccagacggtcacagtcctccagctgcattgcatgcgcaccgccggctgttgccatgtaaaggatctcatctgcacccacgcactcggcatccatctcgcgcacctttgcaagtgcggaggtaaggaacatctcgcggaacatatccagacagttgttgctcgccgggccgtccgtaccgatcgccatggcaatgccctcatccacaaaccgcttcgtcgggcagatgccggaagcaagcttcaggttagaggccgggttcgtcactgccgtcagatgacgctttttaaagatttcaaaatccggctcctcaaaccatacacaatggtatccgccgccgccgtactcatacatgccgagtgagtccgtaagctgtgtcggtgtcatgccccagcgctctttgcactctgccacctcaagctttgtctcggaattgtgcagccataccggagattttaacttctgtgccagcgccgccacgccttccatcagttctttcgaggtggtgtactccgcatggaatccgacaatgaaagaagtcagatcactcatctcattgacgatatgataattttcctccatcagctctactgtaccgccgaaattgttcagtccgctggtctgcactgtacggaatcccgtatctgcggatgcttttgcatcgaccggcgggaagaaatacatatcaaagttggacgtaatgccgctggtcaggtattccatgatgcccagaatgtttaaccagtatacatcgtcctcggtaagctgtccctcgcgcgggaacacctgctgattcagccagtcctgcagtggcagatcatccgcataggaacgtaaaaatgtcatggctgtgtgtgtgtgcgcgttcttaaatcccggcattaacagattgccgcatgcatcaatctcgcgatcccacaccagcacttctccctccttgcacacatccgccgtgtccgtcccgtcaccgatgtagcagatcgtattccccttgacccagagttctccctccgtgatctcaaacttgtgatgatctgcaagggttaagatctttgcattataaaaacgtgtattcatgtcactttctccttcttctgtctgctgttttcactctatgaagtctctctccagcccgaaatcttcactgcgtctctgcggatattattttccgatgctcttgatcgtctccgtcacaagagccttgaacttcggtgccacacggtctgccgtctcctgtacttcctcatggcagaggggaaccgccgagataccgcatgccagattggaaatgcaggaaatacctacaacgcgcatgcccatatgacgcgctgcgatcgcctcgcatgccgtactcataccaacggcatcggctccgagtgtccggcacatcgccacttccttcggtgtctcaaactgcggaccggaaagctgtaaataagtgccttcctttaaatcaatatccagtcccagcgccgctttttttaccagaagctgtaactccttatcatatacctggctcatatccgggaaacgcacgccaagctcgtccacattcgctccgcgcagcggggaaggaacaaagcttgcaatctgatccttgatcagcataaaatcaccggcgttcatgccaagctggatgccacccgccgcattggtgaggaataaaacctccgcgcccatcagcttcatcagacgcgccggaagcacaacatccgacatgtcatatccttcataataatgaactcttccctgcatgcacaccaccggaacttctccgacatatccgaagataaaacgtcccttatgtcccggaacggtcgataccgggaatccctcgatgtcgtggtaatccagtgtgtctgccacacggatatcatccgcataatcgcccagtccggatcccagcacaagtgccaccttcggggtaaaatcgatctttgccttataactttcatagcatttctgtaacttttcatatactagattcattgtcggttctccttttcctttcgatcacaaaattatttatattatataccatgcgctctgaaattccaatctcattcattaaaaaacggtgccattttctctccgacccacgagatgaccggaccgagtgtgaagcccatcaggatcgtcaccagaccgatcttcgcaccgaacacccacgcaatcacgatcaccgtaaaatcaaataccatgcgcaccacgcggaacggtacctttttctgcgccttcacaatcagaaacggaatagcatcgtagggggcagttcccagttccgtaaccatatacacacctgccgcgacgacgaacaccgccagtgccgggaacagcacgccgatgcgcactgccatggaatcaaacagcccgtccggcaatacttttgaccatacccacgagaaaaaatcaatcgaatagccgacgaggaacatattggcaagcgttccgaatccgatgtactcccgtccccacaatatcacgataataaataaaaggcagttgagcagcgcctgccagttgccgagactcatgccgagtctgcccgaaatagcaagattcatgctcgtgcaggggtctgttccaaaattgaccagcaccagccatgacagagcaaatcccatgacgatcaccgcgagaattaccgagatgagtctccttgcaaaatgtttcttctgatacattccctgaataaagtttttcattattttctctccgttctttccgatatatatcatagtaacacaggaacggcttttctgccagagttcccttttactcctgtgcgcttctctttaaaggcagcattatgattttatggcaattatttcccgctaggaatccgtgacagttttttcggaattcatgacagctttcttggattcacgatatttttcattggacagttatttctcatatcatatttttttcacatgaaaggatttttttatgcagacacttcatctgacagggatcaataaacttcttcatccggagcgcgacaaacgctccgccaccgagcgcatttttgaccatttaagccactcaaacatcggattaaaccgcggcgaagcaacggctgataccggctctgcggcatcggcgctcgacagtttttctgtcacgcagaatatctcggagcttctcagtcccgcctacggcatgagcgaggaagagaaaaaagcctaccttgccaaaatcattgcgaaattaaagagcggcaaaaagcttacatcagaagagatgcgctttctgcaggcggaagatccacagctataccagcaggcggctcgtgtccaggcaatgcgtggctcccttgagtcgggtcttgcgcacagcacttccaaggaggaggcgcaatctgtctatctggacgcgctcacccatatcagcgaggaagatcccatgaaagaatacatcatcgcagcctacgatgatgccatgaaggaattccagaaatccgaccagtaccagtcgctgccagagacaaaagaggatgacgcaaagcagcacaccggttcccgtcattcccatagctgataatttaagttcatgttgcagcaattatctttgtgtgcctgtcttccaagctgccagaacgcaaccgcactggcagctgcaacatttaaagaatcgacgccgtgcgccattggaatgcataccgtatcatcgcatgctgcgatcgtctccggtgccagaccatctccctctgttcccagtacaattgcaagcttgtcctcattcataagcttcggattatcaatacttaaggaatcctctttcaatgccatcgccaccgtatgaaatcccagttcatgaagctgcttctgccaattcccggaatctgctttctcttcctgctccgagtttcgttctatccctgttcccggctctttctcttcttccggatccggatttcgttctatccccgttcccggctctttctcttcttccggatccggatttctcacagtctccggctttgtctcctcaccaagatatgtccacggcacctgaaacaccgtacccatactcacgcggattgctctccggtaaagcgggttgctgcaccccgtggtcaacagcaccgcatccattccaagcgccgcagctgaacggaaaatagcgcccacgttcgtcggatttaccacattttccaaaactgcaattcgttttgcccccttgcagacactccgcaccgaggggagcggctgccggtacatcacacagagcattcctctggtcagttgaaaccccgtcagcttcgtgagtacatcaaactccgccgtgtagaccgggatctccccgcatcgcgcaagaatcttctgtccctctccctcaatatgccttttttccgtcagaattgacaccggcatatagcctgcgtccagcgccctctcgataaccttgggactttccgcaataaacatgcctttttccggctcatggcggttaatcaactgattctctgtcagtcttgcatacacatccaattccggtgcatcaaaatctgttatttctatcatctgtgccattttattcctcttccacatctactgatttctgtttgttcgttgtctcacccgatcttgcggtgccattttcgatcgttttatgctttcggctgttttctgatctgtttctctttgcatcctgacttttgaccgagatttggcttcacagtcgatttcctgggacaatttggttttccttgtaatcaattcattttccctttcgttttccgggcttgatctggctttccgtacggattttggtacctgcatctttttcaaacgggtctgtacggcaaaaatatcctctccagacccgtttttccttgtttcccatcatatttaacatgaaaggccataggaaacgggtctcaggagcactttttcttctctgagacccgaatcacagggaaaaacgggtctcacaggcaacttttcccactatagacccgttggtcatatcaaattcaggatctgagtctcataaacatttaattataataccgatctttatcagaagtgtcaatctatccgtttctacacccggaccggtgtctgtcgtacaaatttcccacctctgtttttcctgcctgcgagttccctgtcacattttcaaatgctcattgcgcttcctcattactgatattttctgatgctttcccgcacattttcctgtcacattttcaaatgctttttctgcttcctttttcttcctgccctacaaaataatgcataccatcccgccgttgttgtcgttcacaattttctgcatagtatcctgcagcttcatttgacactcgtcatccatcatcgagatcttgccgcggatgccgttctccatcagctcaccgatggattttccgaaaatattggtctcccaggctccctcctcgctcttttcgccctctctgatgtaggcgatcagatcattcgcctgctcctcgcttccgacgatcggcgcgatctcggtctcaatattggcacggatcatgtggatcgagggggaggttgcgcggatgcggacgccgaatttatttccgtgcttgatgagcaccggatcttccattttaatatcggagagtccggggcctaccacgccatagcctttcacctgtaccgccgccatcgcgtccgccaccttttcatatgcctcttttcgctgcgacatctccttcaccagcgcgatcagttcatattcgccggcaatcggcacacccgcaagctcgctcatattttcatagtaatacttctcagcgacctccatgcggattttggcgcagccagatgcaagatccacttcctccaatttcatccgcgagacatagtgctccggcgtaaaatcctgtgcataaatatctttcacttttcgcattccaccgaggatcgttctggcgctctgtatgatttccgccttcatcggatgatcgggcgggagcatttccgtccatttcggaatatagaattccatgcgggcgaccgggaactcatataaaatctgctctaatatatgaaagacatcatctttgcgaagctgctcgcaattcaccggcaacaccgccgtctggtacttttcccgaagtccctccgcaatgcggacggtctcctcgctgtagggtctcgtcgaattgagcaccacaacatagggcttgccaatctcctccagttcctgcacggtctgctcttccgcattcacataattttcccgcggcaaatctccgatacttccgtctgttgtcaccacaatgccgatcgtcgcatgatcccttatgactttttccgtaccgatggacgccgcctccacaaacggaatctcatggtcgaaccacggcgtatgaaccatacggtccgtgcttccttccatgtgtcctgtggctccgtccaccataaagccgacacagtcaatcagacggattttaatccgcgtatcatcttcaagcgcgatctctgccgcgtctttcggaataaacttcggttccgtcgtcatgatggtttttccctgtgcagactggggtaattcatcaatcgtgcgctgcctgctatgtacatcttccatatagggaagtaccataagatccataaaccgtttgataaacgttgactttccggtccggaccggtcctacaattccaagatacacctccccgtctgtgcggttttgtatatctttgtataaatcaaactcttttttgctgctgatgtccataaaaataccccttccatacttaataaaatgtatgaagggggatctgtaattattcccgcggaaactaaaatatcatcgcgcgcggatgaccttctggcgcagacaaagccggggatctgtacacttcgcttttctacagcatcacccgcagcattcccggcagacagcggaattgcagcttcgtgacatcaccacagtattctccatccgcatgcagcaccataggatccttcagccggacctcgcatgtgccgcagtcgtctatgtcaaatccgcggattcccgtatgctttgccgccacgaggaacggcaggcataaaaatgtgcgccacttcggaattccgtgtacactgcagatcgaaagctttccgtccgtggcatccgccttcggcgccatgggaacgccgcctccctctgccttaaagttcatcgccgcgatatagatgatgcggtctaacttccgctccggggtctcgtccagacgcaccgcagcctccgtcgtctgcatggaaaaaagcgactgcaccgtaatgagcagataggtcagtttgcccagatgcagcttatttaaaaatactttcagcttcgatgtcagggcttttttgcagactaacgcgtcaagtcccacgccggcactgatggcgaactttctcggcttctcgcagtcatcccatgccacctctcccagatcgatcacggtgcatgcctctctcccccgctgcatgcaggagagcatgcgcgccagattctccaacggcgtgccgctaagctttaaccctctcgccaggtcatttcccgagccggtcggtatcagtccgaaccgcactttttccggatgtgtgatgccgttgatgacctcatttgccgttccgtccccgccaaccactgcaaggcagatatcatcatccgtcttcgcgcagatctcgacagcaagacgtgtggcatgcccctcatgctccgtgacataatgccggtaatggattcctctcttcacaagttctctctgtacctctttccagatctgcgcgcccctgccgcttctggacttctcattcacaataaaataaagcatctgtttctcccaccgtaacatacattctgctgtttccggcatgtgccggacatacaccgctctgttccacgtctgtttttcctatataaacacaatcgaaaacgcccacccggcctctgccagatgagcgtttctcttctgcaatgctcttttttatcgtatcacggatacacggcaattacaactgtttactgctcttttctgtctgcatcttcgcccacccagagacgtccgtacatttccatataattataaagccgtttggcaagcttgacggtaatctgatctgatgttgcacgccactgccagttgccccccagggtggacggcgtgttcatgcgtgcctccgaaccaagaccgatcagatcctgcatcggcaccaccgcaagctccccgaccgaagaccatgcaccacgcatcatgccccagttatagccttcctctttcgtgaggtttaagtattcctttgcaaatttgacgctctccttcggcgcagtcttcatccagccaagcagcgtatcattgtcatgtgttccggtgtacaccacacagtgctccgtgtaggtatgcgggagataattgcttccctctctcgagtcaaacgcaaactgtatgactttcattcccggaaatccggaatccgcaacaagctttaacacggacggtgtcaaaaagcccagatcctccacgataatgtttaatctgccaagcttctgctccagcgtatgaaacagatccatgcccggtcccttgcgccactcaccattctttgccgtcttatcctttgccggaatcgcatagtaggaatcaaatccgcgaaaatggtcaatccggacaatatcgtaaagctttgacattgccgcaatgcgtttcgtccaccaggtgtatccgtttttcttcattacatcccaacggaacaacggattgccccagagctgtccgtcctcggaaaatgcatccggcggacaccctgccacatcaatcggatttaaatcctcatccagatagaactcttccggattcgcccatacgtcagcagaatcccctgcgacgtagatcggaacatccccgatgatctcaatacctttttcattcacataggcttttagctcccaccactgcttgaaaaacagatactgtaacatctgataaaagcggatatccttcgcataggtgcttctcgcctcggcaagtgcctccggttttctcatctttaaatctttttcccaggaaaaccatgcgtttccgccgttggcatcctttaacgccataaacagcgcataatcagaaagccagtctgcctctttttcacagaacgcctcaaaatcgtccggctctgcgcgaaggaaccgctcaaacgcgatctttaacagcttatagcgcgactcgtacatcacgccgtaatccaccttgtctgctttctttccccacgggaaagactcacactccgcctttttcaacagtttttccttacacaggtattccagatctataaaatacggattccctgcaaagctggaaaatgactgatacggcgaatcaccgtaacttgtggggcagatcggaagaatctgccagtatttctgtcctgatttttcaagaaagtctgcaaactttctggcttcttttcccatcgtaccaattccatacggagatggcagggatgatatatgcatcaatactccactacttctcataacctcgtccttacctttcatctatcactcgaatactctccccatttacaaactcaaacggaacaatctcgtgaatcggctctttcttcaactcgatctggccgaataaaatctcgatgctgcggtttgcaagcgtctgatgctgctgcttgatcgtcgccagcttcggattgtaatactctgcaagcgatgtaccgtcaaaaccgatcacggaaacatcctccggcacgcggtaccccagatcacgcagtgcgcggatggccccgatcgccatcacatccgacattgcaaacactgcggtcacatccggaaacttcccgatcaggcgcttcatcgcccggcaggcgcttccaaaagagaatcttgccttctcatagcagtgctccacatcaagaaccgccccatgctccgaaaagctctgctcacatcccaggaaacgctgatgactcgtataagacttgtcaaaatcaccgccgagaatgccgattctgcggtgtccagccacaaacagctgatccaccgcacagcgtgccgctgcaatatcgtccgtggcaacgctggaaagattctcaaaatgcatctcattggcacggttcgtcaccaacacacacggcacatccacaccggagaactcccggtgaaaatattccggattaccgccgaggaacaaaagcccaagcggctttctctccctgcaaagaagaattgcctgctctacctcatctgcatcctcgtccagataagacacgaccagcgtatattccgttttctcgatcatgcgctggatttcctccacgacactggcaaaaagcatatttgagatacctttgaccagtacgccgattgccttggaattgttctgttttaaatgcttcgcattgttgttcggcacaaaattaaactttgcgacaacttcctcgatcttttttcttgcatccgggctgacatcatttctattattaagcactctggaaaccgtgctgacggaatagcctgactctctggcaatatcttttattgtaaccataacttttcctgcctgtttttgtcttcttgatttcactggcaattattatatcagcctttgacagctcctgcaacaacaccttctataatatacttctggcaggctgcataaaaaataatgatcggaacaatggcaagcaccagcatcgccatcatggtaccccagtcaacagcgccgtagccgccctttaaatactggatgacaatcgggatggtcttgtattttttcagatccagcaccagataaggcagcagatagtcgttccagatccacattgcctgcagaattgccaccgtgatcgtggtcggcttcataatcgggaataccacctggaaaaaggtctggagcggcgtacacccgtcaatcattgccgcctcctcaatctcaagcggaatgctcttcacaaaaccgcagaacataaacaccgccagtccggctccgaatccgaggtataccagaataataccgatgggattgcttaaatgcatcatgttcgccagctttgacagggagaacataaccatctggaacggcacgatcatggaaaacaggcataacatgtagatcgtggagttcactttgttatgtactctcgtaatgtaccatgcgcacatggaggtacagagaatgattaccgccacagaacctaccgtgatgataacggagttccccatcgccgcaaaaaagttcgtcttctgcacgcccttgataaagttctcaattccgaagaaagaacggtgatccggcagtgcaaacggatatctcgtgatgaatccttttttctttaaggagttcatcgccacgaggaaaatcgggtacagccacagtaccgcaaggattgagaaaaatacagtcaaaacccatccgtgtttggcgcgtcttaccgcgcttacctgattgtctgcttttttgttctttgccattattgctgcacctccttacttctggtaagtctgttctgtagcattgcaatgactgccacaatgataaagaataccaccgctttcgcctgaccggcgccctcccatccggttctggtgtagaatgtctcataaatattcagtgccagcatctgggaactgttcgacggctcgcccgcagtcagcgccaggttctggtcaaacagcttaaaggagttcgtcagtgtcaggaatgtacagatcgtaatcgacggcattaccatcgggatcgtcacatggcgcagcagctgacggttcgtcgccccgtcaatctttgccgcctcgatcagctcacccgggatgttctggatgccggcgatatagataatcatcatataaccgatctgctgccagttcattaaaattacaagtccccagaatccgtaggttccggaataggtaagtgtctttccgaagttcgccagaataccgtttaacaggatctgccagatatatccaagcacaatacctccgatgaggttcggcataaagaacacggtacgaaacaggttcgttcccctaattccctttgttaaaagcatcgcgatcgcaaatgcaaacacattgatcgtaagaacggacacgaccgtaaacagtgccgtaaacaccagcgcatgtgtgaatgttgcatccgaaaaaatccggatataatttttcagtcccacgaactttgcatcagtcaccgtcgtaaattcacaaaacgataaatagatacccataataaaaggaattataaaaccgattgtaaatgccactaaagtcgggagtgcaaaaacaggaaaatatttcttaattgatttctccatactctttcatcctctcatattcaataaaaccgatatcgggcagatgctttgcagtacccgcatccttctaaaaaagggtgagcagttctcatgcccaccccctgcattttacagatttttattcgtgtgttgcgtcgtactcagtcttccatccatctacgaatgctgtcacaacgccatcccagtcgccggtaccctgtgcatactcaagtaatgcagaaccaacgccatctttccatgtctcagaaggaatagtggagaagttccatgttacagaatacttgccagctttggtgtaagctgcatctgcctggatgaatacattgtctgctgtgtaaccgtcagcaaaagtatcaaacggtgttgtgaatcccattacattagccatggaatcacgtccctcatcagatgtgatcacccactcaaggaaatcaagtgttgcctgctgatcctctgcggatgcctgattattaacgcaccagtagttctcagaacctgtgcagagtccctgattttcctcaccgtccacaccaatgtagatcggcatcatgctcatgtcctcagctgttacgagataaccgttatcctcattggtcaggttgctgtactcccatgtaccgttctggtagaaaacagcttcttccataccgaactcggactcagcctcgtcaccggtcttgctggaaagaagacccggctcacaggtggaatctgtaatgtagagatcccagatctgcttgtagttgtcaaggtatgtaccctcgattgcatcggtggaatcaatgcccttgtccttgtactcatagtagatcggaaggtttgcaaggtgtgtcttaaatctccagtcggaagatccatccatacctgcggaagtaaatgctccctttaagtcatatccgaactggtcgttgatctcgtctaatcttgcctgaatgtcgtctgccactgcctttaatgtctcaaagttgttgatgtcttccggagaagagatcactgcgttgtccattgtgcagtagtcgtttaagatcgtcttgttgtaaatgatgccataagtctcaattacatatgcgataccggaaacctcgccagcgtcattcttcagtgcatagtcatcgctggtcagatgggagtagatctcgctgtttgaaagatccagacagtaatccttccagtttgcaagtcctaccggtccgtttacctggaataaggtaggagcttcggtcttggcgatctctgactttaacgtctgctcgtaagtaccgtctgctgctgtgataaccgttactggaacacctgtctgctctgtgtaggttgctgccagatcctgccatgcctgatcctgctccggcttgaagttcagataataaactgaaccgcccgctgcatccgtcttcgctgcatctgtatctgccgcctctgtggttgttgcagctgcgtcgtttcctgtggtagctgctgcgttactgtctgttgtgctgctgtccccacatccagtaaacatcgttgcgagcattgcacttgcaagcattacggataacacttttcttttcataaatttaccctcctgatatgatttgttcaacttcttatgtaacgtttccggtattgttatcggtaatgtttccggtaacgttttcagttgatggttagattatatttccatgtgtcaggaaatgcaatacccaatcgttattttccacattattgccaagtttcatgaagacattttgtgatatttgtacaaaagaaaggctgccgcgataagcatagacctctttggggtgataagtaatattacaagaaatagatacttaaaagttccagataaacatgcggcgacaaattctgaacgcaaaatccggtatttctaaccatgccgcagctggcatctgtgatgatccatgtctttccaagtttggagcactccacggactgtatccgcaggccaacagacaatttgtaggacttttgtgtgtgtcccttatggcacctttgaacaaaacataaccgcgcgaagccgctgtctgagtcggcatctgccctattttcaatagcagatgccggcgagttcggttcgcgcggttttatattgtctgtgaagaggtgccattagggacaccagaaagtccgcccattgtctgtggcttgtcggacacagtccgtgagtgtccaaacgtggaagagacacggaatgggatgtcagccacggcacggaagaaatacacgaattttgcttcaaagaatttgccgccgtctgtttattctggaacttttttgttctctagtattcctgtaatattacttatcaaagcacgatatgcttattgcgacagcctttcattgcacattttatctggtcgaagatcttatcgtcctcccgtcatgcgaagactctccaccccataaacgatcacgcctgtcagccagacaaaaagtaccatcgtaagcggaagcagcccaaaattccaggacagcatccctataaagcagaccagaaacattccgagcgccgcataattcattgcggtgtaggcacggaacgccgcgcggtatatctgcagctgttcggcctcatcgcagcttgcgatccacgttttctggaacttcagatcgtaaacgcttcccttcttttccggattgatctccttcgtaaaattcacaatccggttctgagcgatcaccgttacgaccataaccgcaatcagtcccaaaaatgtggctgctatttttacccacggaacctcttcctcccagccgctgtctatgccggtggacttcatgccggctgcgaaaaagaaaaatcccgcaatgagcgccacattcgtgacaatcacaccaatgcccagtttccgctcgatcttttcgatcaactgctcttcctcgccgtcccagcgcctgtactctgctctgccgccgcgaagcattcccgtcatccacacagccagagctgccgcgatcacaagatttgcatagggtgcgatcttttgaagtcccgctgtgattcctgcgccgatatccgcctgccccttggctgccatggtcgaaaacgcgcctgttatcccgcccacaaccatggatactaaaagaagcactataaacttgcggaatgctctcctatcctctctctgattctcctcaatcttcgggttgcatttctctgtcccatctgtcatacgcttctcctccctgcctgctatttttcttcctctgattcttcctcataggtaaaaatggcttccaccggaacctcaaacacttttgcaatcttaagcgccaacgtcaccgacggcgaataatccccgcgctcgatctgactgatggtctgcctggatactccgaccagctgtcccatctcgtgctgattgacgttgatttttgcccgatattcttttaaatgattgtataatggcataaatcctccatatcccgatgtgcttttcacacaacgcaccgctttctttgcggcacattttctcacaccgttattatagatatgacaaggaaagttgtcaatacatttttgacaactttccttgtcacatcagtgcatccgacagcgcatgactgacggaacaaccatagcggcatactattgtaaatctgtttgggaaatgctaaaattcagatataagagtatgttatggaaagggaatcacatctaattatgaaagagatcatcaaacataagataacccacaatgtcaaccgcttaaagacttccctgaaatgggtggtattcgccatcctctccggtgtgctggtcggatctgtgggcacacttttttatctgtgcatggctctcgtcactctcgtccgcacaaaaaatccgtggcttattttcctgcttccggtcggaggtattctcattgtaggtgcctaccgcctgcttcacgatgagcgcgataccggcacaaaccttgtactctccgccatccattccggcgatgaactgccgctgcgcatggcgccgctcatttttatctcgacgctgatcacccacctgttcggcggttctgccggccgtgagggtgctgccctgcagctcggcggcagtattggaaacggtctgggacgtctgtttcattttgatgagaaggacaagcacatcatgatcatgtgcggtatgagcgctgcgttttccgcgctgttcggcactccgatggcagccgccatcttctccatggaggtggtgagtgtcggcatcatgtactatgccgccctcgtgccatgtgtgatctcctcgctgatcgcccacgcgattgccacctcgttcggcgtgagcccggacggcttcccgctcggaaaaattccggattttacgatcggctccgccgttgaaatttccatcctcgccatcttatgtgcgctggtgagcattctcttctgcgtgatgctgcacggttcagatcatctgtataagaagttttttaaaaatccctatctgcgcgtcttcgtcggcggatgcattgtcgtcgtgctgacactgctcgtcggggatcagacctacaacggtacgggcatcaacatcatcgcccgctgcatggacggtaccgtccgcccggaggctttcttcttaaagatgctttttaccgccgccacactcggcgcaggttataagggcggcgagatcgttccgtctctctttaccggagcggcattcggctgtctgttcggaaatgttcttggattttcgccgaccctgtgcacagcggttggcatgtccgcagtcttctgcggcgtgacaaactgcccgatcacctcactgctcatcagctttgagctgtttggatatgacggtatgccgtatttccttctcgccatcgcgttcagctatatgctgtctggctactttggtctctaccagagccagaagatcgtctactccaagtacaagaccaactatatcaacaaaaagacgcactaacaggaatagaaaagcgctgccacacgaggcgctgattattatgagtgataccaggaaaaataggagccaaacgttccggatgatatctgtccaagacagatctgaccgtaaaatccggtatttctaaccatgccgcgtccggcatctttgatgatccgtgtctttccaagtctggagcactccacggactgtgtccgcaggccggcagacaattttagggtgttcgtgtgccccttaccgaattgctgaacaaaacataaccgcgcgaagccgatgtttgagttgccatctgccttttttttaatggcagatggcagcgagtttcggttcgcgcggttttatattgtctgtgaagcaattcgattaggggcgctagaacgcccgcccattgtctgcggattgtcggacacactctgtggattgtccagacgtggcaaagacacagaataggatgtcagacgcggcatggaagaaatactcagattttacttcaaagatctgccttggcagatacattcggaactttgtgccctctaatctcctatcctgtcactcatgctaatcagcgcctcgtgtggcagcgcttttctatctcctattctttctcgatacaacggtcgagctgtgcgagcagatcttcgtacttgcagagcccctgcttgcgccagtcgcattttccacagttctccataaagaaatccatgttcatcgccgcgcgtgcgtgtctgcacatctcgcggtatgtatagaccctgttctcctcgagtccgaagaattcgatgacccggcggtctttgttcacgacacggttgtggttgtggacgcactcgttcgtctccgtccggttcggacagttcgcacagatcatatccggttccgccaccagaagaagttcctcgtccggatcttttcgcaggcgctccaccaccgccgtcatattttcacaaaacgcaccgctgtagccttttccctcatagagcgaagtacagacgatgtgatgtcctctgaatttgtctgccatagcaactgtacactcctaaactgccgcttttgtcttctcttccagaatatttcctgctgcaagcgccttgcggatcggaattgccaccagatacgcgcccacaacggagatcacgtccttcacaatgtaaggaacagataccgctacgaaagcagccggaaacggtgtggcagccacgatggcgaactgaatgacaccgagcagatgacacacagcaagaccggcaagtcctaacagcacgcggagccagatctgcttctgtgccatgcccacgccgcagagcattgtcaggaaaatgaatccccagataaatccgccgctgtagccggcaagccaggacggtccgcctgtcattcccgcaaacaccggaacgcctactgtaccgagcaggatatagatcaatgtggatgatgttccctttttccagccgagcacatagccgcacagcgccattgcaaaagtctgaagtgtcaccggaacgccggtcggcatcgggatcgtcaagatggacaacacgctaagcactgccgtaaacatacccactgttacaattgtctttgttgaaatcttcatgattctcctcgtttccgcaggaatcgcatattttaccgctctttcctgctgtttttcgcgcagaaatcccctgtgggtctctctgtctgcaaaaacaatcataacacttttttgtcgattgtcaacctgttttgtctcgcggttgacaattctctaattgcatttccggttctttccaaaaatcaggtcgtaattgatactgtgatagaaaacctcctcgatatcacaggacgatatatcatagttgccaagcatccacatcaccttcgcaatcacggactctaacgtcatatcgtaggactctaagaagcggcaatattctttcatgttgtggccgacctcgtagaccgtcatatcgcttccctcgtgcgccacctgcgtcgccatgaccaccagcttgtccggatgctcctggcacagccggtaaaactcctctgcgatagactgcggtataccgcccacgccaaagctctccacaatgatacagtcataattttcaaaaatactctttaacaccttgggacggattcccgggatcagcttcatcaggaaaacattttcatccagcttctcatagaaccggacttcctcctcgtacggaagcatggggatatagcgcataatattcatgtcctgtatcacggcgagcgacggatagtcaatactggaaaatgcattgtagctcttggaccgcaccttcttggcgcgggttccggcgatgacttttccatcaaacacaatctgtaccccctgtgagcggtcatcggcagcatataaaaagctgtcgatcaggttcgacttcgcgtccgtgatctccaggtcgatcggcttctgcgcaccggtaatcacaatcggctttttcgtgttctgcaccatataggaaagcgccgctgccgtgtacgccatcgtatctgtcccatgggcaatcacgaatccgtcaaaatcgtcgtagtgctcccaaatcgcatgaaccatgagtttccagtgtgacggctccatgttggtgctgtccagatttaaaagctgaaccgcctcgacatcgcagatctcttttacctgcggaatatactcgatcagctcctccggtgtaatctgcggttttaagccgttatccgactttctggacgcaatcgttcctccggttgccagtaataaaatacgtttcttctgctgcatactctctctccgttctatcgtaataatcccctcagtgcagcaagaagcgcctccacgttttcctctttggttgcccagcaggtacagatgcggacagcgctatgcgtatcgtccacacgcgcctgatattcaaatgcaaaatcgtcttttaacttttcaagcaccgcatccggaagaatcacaaactgctggttcgacggcgagtccacataaaattttacgcccatgtcctttagctcatcatggatcttttccgcaagccttgatgcatgcgccgagatctcaaaataccttttctcctcgaatagcgtgaggaactgaatgccgagcagtctgccttttgccagcatgccgccccgctgcttcatattgtaacggaaatcgcgcttcaattcctcgtttgtgatcacaaccgcctcgccaaagagcgctccgaccttggttcctccgatgtagaagacatccgtgagcgccgccacatcggcaagtgtcagatcattttcccggcatgtaagaccgtagcccagtcttgcaccgtctaaaaacagataaagccctctctctttgcagacatcatagatcgcctccagctccgcttttttatagatcgtgccaatctccgtcggattggaaatatagaccatcttcggctgaaccgtgtgttcaaaacttgcgtcggcataatgcgcgtccgtatatgcagcaatctgttctgctgtcagtttgccgtccgccgtctcgatcgtaaggcacttgtgtccgcaggactccagtgctcccgtctcatgtacgttgatgtgtccggtcaccgcagtgatcacaccctgatagtgtcttaatgcagccgaaatcactgtcacattcgtctgtgttcctcccaccagaaaatgcaccgctgcctccggtgcggcgcacgcctcttttatctgctccgcagctgccgcacaatatacatcctccccgtatcccggggtctgttccatgttggttgccgcaagtctctctaagatcgccggatggcatccctctgtgtaatcactgttaaaccgtatcatctttctgattccttttctctatgtatttgagacgcgaaccagctccttcagcttccgtgctgccgcgccgctgtcgatcgcctctgccgctaattttacacccgcttccatagattccgcaacccctccgacataaagagttgcacctgcgttcaaaagaacgatgtcacgcttggcgccgcgctccgttccgtccagaatggctctcgtaatctttgcgttttccccgccgcttccgccacgcagctcctccagcgatacgcgcttcataccgaactgctccggtgtgatggtaaatgttgtcaccgctccatcccggatctcggataccgtggtcgctcctgtaagcgtaatctcatccatgttgtcctcaccgctgaccacatacgcgcgctccaccccaagtctgctcatcgccgtcgctaccttttccgtgagtgacggactgtagacaccgaccaccatattttttgcgcgggacggattagcgagcggtcctaagatattaaagacggtacggattcccatctcactgcgcgcctgcccgacatagcgcatggacttgttaaaaagctgcgcaaacatgaagccgatgccagccttctccacgcattcctccactttcctcggatctgccatgatattgacaccgagcgcctctagcacatccccggcgcccgatttcgacgatatggagcggtttccgtgttttgccaccgggagtcctgcagcagccaccacgaacgccgacgtggtggacacgttaaaggtaaatgtgcgatctccgccggttcccaccagatcaatataattatcaaccttcggggaaatcgtctcagccttgtcgcggagcaccgctgcaaatccagccagttcatccagcgtctcgcccttcacgcgctccagcgccagaaacgccgcgatctgcgcctgcgtcgcatcaccgcttaacatgatgtccatcgccttttttgcttcttcctcagtcagattctctccctcagcaacctttgcaatatattctttcatccctttttcctcctctatgcgttcagttcctttttaaaggtccggcagtatgtctccgccgcctccggcgcaaagccctgctcctccagcagcctgataaaataacttccgacgatcgccccgtcgatcagatccgcaagcggcagaacgtccgccgccgtccggatgccaaagcccatcatcaccggcagatctgtcgcttcccgtactgcggtaagatagcttcttacctccttatggaactctgctccctgccccgtgacacccatggacgatacacagtagacgaacccccgcgctccggcgagaatctttggaatccgcgccccggacaccggcgacacgagctggattaagatcgtatcctccgatgcgttaagcaccgtcatcagttccgcctgctcctcaaacggcagatccggaacgatcagtccgtccacccccgcctcattgcatctttttacaaacgcttccacgccgtagtgcaggatcgtgttgtaatacatcatgaagatgatcgggaccgtcacaccctccgtgcgcagttcctgcatcattgcaaaaatcttcttcacattcaccccgccgcagattgcacggtacgatgcgtcctggatgaccggtccgtccgccaccggatcggaaaacggcacgccaagctcaatcacgtcgcagccgccgcgctcctgcgcccggatgatttcttttgtggctgccagatccggcagtcccgcggtaacataagtaataaatgctttctcctgctttttgctgcaggcgttcatacgcgcttctattcgattcatatctgtcatatcctccctcgccggacaactttccggctcaatttaaatatccttttcctgcaagataatctgcgatcgtattgacatccttgtcgccgcggcccgacagacagatgaccatggtctcctttgccgcctgcttctcaccgaccgcctctttgcgctccctcgcgtacttcatcgcataggcaactgcatgggcgctctcgatcgcaggaatgattccctccagtctgcacagctccatcagcgcatccatcgcctcatcatcccggattgccacatatcgtgcgcgtccgctctcctttaagtacgcgtgctccggaccgacgcccggataatccagccccgctgagatggaatgtgcaagctggacattgccgtccgcatcctgcagcagataggaacgcatgccgtgcagaactcccggctcgccgagcgccatcgccgacgcgtgttccccggtctcgattccctttccggctgcctccacgccgatcagctttacccccttctcctcaataaaatccgcaaacatgccgatggagttcgatccgcctcccacacatgccagcacgacatccggaagcttgccctccgccgcaaggatctgttttttcgcctcgcggctgatgacgctctgaaactccttcaccatcttcgggtacggatacggtcccacagccgaaccgatgatgtaaaaggtatcctccgccgtttttgcccaggtgcggatcgcctcgttggtcgcatcctttagcgtattgcttccggaagtgacactgacaactttcgcgccgagcatctccatgcgcattacgtttagtgactgtcttttgatatcctcggctcccatatagaccgtgcactccatgtcaaagagcgctgcgccggttgccgtcgccacgccgtgctgccccgctccggtctctgcgatcacctttttcttgcccatgcgcttcgccagcagaatctgtccgatcacattgttaatcttgtgtgcgccggtatggtttaaatcctcacgctttaaatacattttcatgccgtacttttcactgagacgctccgcgtaatacagcggtgtctctctcccgacatactgttccagataatagtggtattgtttgagaaattccggatcacggattgcttcctcgaatgccgcatccagttcctctaaagtattcatcagcgactccgccacatactgtccgccaaatgctccgtaatatgctttcctgttcatgtctcgtctttcctttcctgatcatgttccgccgcgccttcttcctgttcagacgccttctgttttttgcacggctttcttaaattttttaatcctgattatactttttgctctcattccgtcacacagcgtttccacgccgctgctgacatctgcgacatcgggggcaaagattctgattccctccgccacattctctgcgttaagtccgcctgccagcacaaaagtacgcccctctgccagcagttcctcccggaacgcacgcacggcacagcacatctcatcctgtccgttctgttcccagccgaatgtctttccgctgccgtacgctccggcatcaatcacaaccccggcaatccggtgatattcttctctgcgccatcggcgaacctcggcaggatcacggaggttgactgccagccacaccggcagcttcgtctgcgctgcgatccgctccgcctctgcggcatccacgccatgcacctgcagcagatcaaatcctgcacgcccgatctcctcaatcaactcgctctccggcgctaccgctacagctacttttcttatatctttatttaatttttcaaataattgtcttgctttctgcactgtgacataacgtttacttttctcgtacagcacgaatccggcgtaatccacacctgtctcattgagcgttgctatctcatcctctcctgtgatgccgcagatcttgatcttcgtcaatgtccatcctccctaccgctgcttccagcgcgctgccacctctcccgggtgctccgcctccataaaggctctcccgatcagaaatgcattcacaccgcatgcttttaagaactccacatcctcatccgatacaatgccgctttccgccaccagaagcttctcctgcggcaccatgcggcttaatcgctccgttgtttgcaggtcaatggaaaaatccttcagattgcggttattgacgccgatgatctttgcatccagctttaacgcccgctccatctccgcctcgtcgtgtacctcgactaacgcatccagccccagctccccggcaagctggtagaattcatgcatctgcacatcgtctaagattgccgcaatgagaagcaccgcgtctgcaccgatcgcccgcgcctcatagaactggtatggatcaatcatgaaatccttgcgcaggatcggaagatcggtcatctgccggatctgttctaagtacgccgtgcttccgtcaaagtgatcctcctccgtcaggcaggagatcgcatccacagaagcattgtattcctcaattctatccagtaagttaatcttgcttttaattttaccgaaacttggggacgcctttttgaactctccgatgatggaaatgacatctccctcaagcgctcccttaaaatcatgatggctgccctcatacgcctccgccagctttcgcatctcctgctccggtatccgtctcttatgttccggcagtcttctttttttatcgctcacaatctgatccagtatcatacgctgctcctcccttaaatgacacccgacaggaaattctcgatcatccgctttccgtgttccgtgtagatggactcggggtggaactggagaccgaccaccggatactctttgtgccgcatcgccataatctcgccgtccgcggtctgcgcggtgactttcaggcactccggcagatcgtctcttagcaccgccagggaatgataccttgccaccttaaccggcgtgtcgatcccggcaaagacgccgtccagacaatgtgtgacctcggactgttttccgtggaataatgtcttcgcatagctcacggttcctccgaacgcctcgccgatgcactgatgtccgaggcagatgccaagaatcggtattttattgtagaaatgttttaccacgtccatacagattcccgcctcttttgggcttttaggtcccggggagagcacaatgcgctccggctgcatattttctatctccccgatcgtaatggcatcgttgcgcaccacccggatgtccggcgtgaaggttccgatatattgatagaggttataggtaaaggaatcatagttgtcaatcaaaagaatcataagttttcctcctccagaagtgttcttgcaagcgccatcactttgttgcagcattcctgatattctttttccggcacggagtccgcgacgattcccgcacccgcctgcagatagacctctctgcccttcttgatcatcgtgcggatcgtgatgcagaaatccatatcgtcggaaaaatcgacataaccggtcgcaccgccgtagagcccgcgccgtacctcctccaattcctcaatgatctccattgcccggatctttggtgcaccgcttaacgttcctgccggcaggaaggatgccagcagatcaaacggatgatagctgccctttttccttccctccaccatggatacgatgtgcatgacatgggaataattccgcacattcataaaatccgtgaccttgactgttccgaattccgagatgcgccccatatcgtttcgcgccagatccaccagcatcacatgctcggcacgctctttctcatctgccagaagttctctgcgcagcgcttcatcctcctccactgtctttcctctcggtctggtccctgcgatcgggcaggtaaacacacgcttgccctgctgttttactaacatctccggcgaacttccgatcacctcaaaattaccgaactggaagtaataaagatacggcgacggatttaactcgcgaagctccttataaagagaaaatccgtcacgtccggtctccaccgtccatcgctgggagagcaccgtctgaaagatatgtccctctctgatatagtgtctgatcttctccaccttcgcgctgtacgtctctggcgtatccgactttttgcggatgacgccgtccctttttccgccctccggctgcgccgcctcctcagtcccgtgcccggtgtccgcttcgcacctgctgtcacatcctccctctgtctgctccggatgcatggcgcgacgtatcatctcttccgccgtcacgccggcacgctttcttccttcctccgtctcctcctctaagacaaccgcggtcagcgtctccgccacatagtccatcacgataaacgctttcatcaacatcagctgaatcgtctcaatcccgatctcatccggattcttctccggcagtttttccgagtagcggataaaatcgtagccgacattgcccaccagtccgccggaaaaattcagttcgtcattctccttatgaatctcaaattcgtcataatattcttttaacagcgctaacggattgcccctgcgcaccccgcgctccccgctcttttttgtgatgacaagcgactccccctccgaggagatcagttcctccggttcccccaaaaacgtataccggtcatagttcttgtcatagctctcgagcagaaatccctttctgcttccgaccagattctcgtacatcgccgtcggcgtctcgttcacaatgctgactgttttcttgtagaccttatagatgcgcttcataaatcctcctctttctttttttaattcatagaaaatgcgtcccatcaagaaagaatcctgctttgcaggattctccgcctgcggcgggtcgctctagcgacataattccgctctgacgcagtgcgatcctgcccggagggctttttaattcattggacgtaatttcccatgaatttaaaaaaatccctgacccggtaaaccggatcagggacgaatgtctcgtggtgccacccttcttctcttgccatgcttagcttctctctttttatcagccgtcctcaccggactcatctgacagaagatacaaaaagcggatacttccaaactggaaatatccgccaccaatcatgtatagactctcagatacagatgttctctatatcgtacccctgtaacgtgaggacacggcttccgctactcggctgctgttatccgcctttcactttgctctcgcaaatccattccatccatactatcctgcctgctcccaccgccccaggctctctgtgaagaatcgtacagtgtactccttttgctcaacgatttctcatttatttgtcagtagtttactgcactaatgtggcaatgtcaagaagctttttattttcccgtcaccttttttctatcaatatgatatactttaagcattgatcctgttacaggaaatggaggaactctcagatgaacaatgatgtatttgaaacaatgcccgtaccgaaagcctatttcaagatggctctgcctgtggtgttcggcatggtcatcagccttgtatacaatatggtcgacacatggtttattgcaaagacccagaacaccagcctcgtcgccggcgtctctctctgcgccccggtgttcagtctcatgattgcattcggtgatattttcgggcttggcggaagttccgccatctcaagacttttcggaaaaaaagattatgacaccgcgcggcggatcagtgctttctgccttctcggctccatcttcttcggcattgctgttgccgttctgatgctgctttttcagacacccattctgcatcttctgggtgccagggacgataccatcgcttatgccggcgcctattaccgctttctggttctcggctgccctgccattatctttaatattgtcccggggaatctgctccgcacagaaggtctggcaaatgatgccatgattggttccgtcatcggcgctgtgtttaatattcttttagatcccattttcatcttctctctgcatatgggtgccggcggcgccgcacttgccaccatcctgagcaatctgcttgccgactgctatctcgtgtgggttgtattcaaaaaggcagggcatctgtcgatgtcctgccgcgaaatgcatatttcatccggtcatgtccgtgacattctgctgatcggaattccggcttccatcacgaacctgatgcagagctttgcggtactcctcaccaaccgttttctgttaccttacggttctgataaagttgccgctcttggcattgccttaaaagtcaacatgatcaccatgctgattctggtcgggttcgccttcggcgcgcagccgctcctcggctactgctacggtgcagacaaccgcgaacgcctgaaacagtttctgcattttgatctgctcgtgcagcttctcattgcgctcgttttcacagccgccgcctgtatttttgctccgcacatcatccgcatcttcatgcaggatgatgtcatcgtggcctccggtgccctgatgctccgttgtctcatgattaccgcccctgtgatcggcatgatcttagtcttcaccacactgttccaggcagccggcatggcgcttcccgcttttctgatgtccatcagccgccagggcgtgctgctcgtgttgtgtatgctgctcttttcttccctgttcggctacatgggaattctgctcgcgcaggcagtctccgatgtcctcaccggaattctgggctttcttctgctgcgcagatcaaaaatactgctctgatgcgccgtgcgtcacaccgtctctgcgctgcggtaaacctgctcaaacgtatctcttgcagtattatgcttcccgatgtcaacaaccaccgcaccgatggacatggaagactttacgtgatccgggagcagggcaatcttctccttgtacagcgcgcaactttctttgcgtacttctgaatctctgcttcctccgtgattccctttaaaaacaggcagaactcatccccgccaagcctgccacagagatgttcattctgacaggtctcgcggattgctgtgccgagtgtccgcagcactttgtcgccgatgtcatgtccgtagtgatcattgacctccttaaaattgtccacatccatcataaacatggtgccggcaccgttctgatacagttcatcaagcatggaaatcttaaactgctctctgtcccagagcccggtcagcgcatccacatgcgcagacatctccgcctgatccagccggttatagtgttccgtcatatcaatcgcccggatgaggtatccctgattctcccccatctcgtttaactgctctgcccgcacgtcaaaaagagcttccttgatcggcacccgctgcccgtgtccgcgcagaatctcatcgaattccatatagtgcacacagcatccagctcttccgtggtaaacaacagatacatggagaacaccgaaaatgccgactcaaaccagtaaatgatttttggcagcgcaatgcggcaaaactccgcaaaaaatcaggtaaacccgatgaccagaaaaagttccccgaaatattctacttttaccgaagcaaacacactcccaagatccgccgatgtcacctcaagcaaaaaaccaagcacataaatcaccgacgccagcgcaaatacttccgacctgcgctctggaaggtctcgcctgtgttattttacatattgcaatcctctgcgcaccggattgcgcaattttacgtctccatatgccgcattgcctgcaccatcgccataaaatcctgctcctttaacagcgcaattccctgttcttcatctcccagaaccatcaatacatcccccggctttatgtcaaaaatttttctcgcctttgcaggaatcacaatctgccctttttcaccgaccttcaccattccaaacgcatgctttcccttcggcaaacacctccgcgatcagccggctcttctccacatccgggagggactctcccgtctcccttaattaaagatattgttgggtaaaaaagaaaggtcagtcgattttgccgatgaagcggtagtagatttctacttcctgctcacggcttccgtcctcgcccttgacagcttcgtggacggttattttttcaattagagtgttcagaagttcggcggtcagctccacagggttgacatactgtttcatcagggcaatccacttttcagcatccgctgcggtctgtacggcggcttccatcgtttcgtgaagctgtcttatttttgtttcaagctccttttgctcgttctggtacttctcggacagcatattgaagttatactcggttatgcgtccggcagaccagtcctcatacattttagcaaacagcccgtcaacctcggctttacgcttctctgcctttttcagctccgcagcctgctttttcttcgcagagtttctttccctgtcgctggcattgagcaggcgtttcagcagattgtcctcgtctttctgtgccagcatagaccagtattgcagtcttgcaagcacataggcatacagtacatcatagcggatatagtgcatggaacactggcgtaatccctgcccgttcttgctgcaatggtagtacccgtatgggttcttattctgcttgttttccccataggctaaagaccatccgcagtctgcacattttatcaatcctgcgaaaatctgtgtcgtaccgtttctgcgtttcctgcgtctgcttgcaatcagctcctgaactttttggaacacttcttcagaaatgatggcttcgtgggtattttccacacgataccattcttcctgcggcttccgcacctttttcttgttcttgaatgaaatgttgctctgcttgttgtgaatgctgtgaccgatgtaggtttcctctttcaaaatgctcttgacctgtgctatcgtccacgcataggctttttctgcgggcgcaccggcgtagatattggcgaaagtcccgtatctttcatagttcagccagccgggggtaggtactttttcctccaccagaatccgtgtaatgctggcggctccacgcccgtgtacagcaaggtcaaaaatcttctctacaatccagcgtgtttccgggtcgatcagaagatgaccttttttgtccgggtcttttacatagcccagcggtgcataggctccatagtgtgcgccattggcaaatcttgtgtgcatggcagccttgacctttttgctggtctgtcgggcgtgcatttcattcaggatgtttaagaacggtgcaagctcgctttctccgttgatggtgtccacattgtcattgatagcaatgtagcgtactcccttgctggggaaatagatttccgtgtactgaccggtcaggatatagtttcttcccagacgggataagtcctttgtgacaacgcagttgattttcccgtcttcgatgtcatcaatcatcctttggaaacttggacgctcgaaatttgtcccactccatccgtcgtcaatgtactcgtctacaacggtcagcccatgctctgcggcatactgtctaagcatcatgcgctgggtctggatactgccgctttccccctgtaattcatcgtcacggctcaatctcaaatatagtgcagtgttataaatcgttgtattgtatggttgtttcacggttaaaaatcctccttctaaaagaaacaacccacgcttatacaatactcgctggtacaagtatatcataagcgtgggctgattgacagtcgttattccgtattttttcaggaagcggcggcagcgtgctggatcacatcttccagcaggctgtcaagcggcttcccatcctgtgcgaaatgctccgataccttgatacggactttccccatgacaaaatactgggtgccgtctttttcggtaagcagggtgccgctgtttttgttattgctctcgtttttgctttttgccataggcagttacctccataaatgaaatatgcccgacaagggaatgtcagacaggtgtacagccgcagactgtctccgtgtcaaccaaaccgtgtcaaccggcagaaaagactttgaaaacaatccataggcgctctattattactttttactttttctttgatttcttggttgacatggttgacaaaggagagaaatgccccaaatatcaggcttttccccgtcaaccggctgtcaaccaaagcgtcaaccaaactgtcaaccggtggcttttcagaatggaagttccatttgccgggcttcttcttccgtgatttcctgaaaaccgtccccctccggcggagcttggttgacacgctcccagcctttttgagaaccgtatttcttataccgcttcggacttttgtaggctacccagccctgtatgatgccgcccgcaatgccggtattcataatctcgcagattgcccgtgtctcccagtctgccggggaatttaagttccccagcgcttcctcataaagctgcttggaacataccctgtcgccggtgtagtcctccaaataggcgtagatcatgccggcctgtgtgtcttcctgcataaagtcctgctggtgggcgttcaggtatcggttcatttccatgctgaatgacagcttatacttcccactgcgataaaccgtcatggcttccgcccacatctgttcgatatacgccctcgccgccgcttcatcgtccagtatgtgaacctccgcccgttccgggtacaccgtcacggggagaaagcgccggttgccggtgcggtcacggggcaaaaagtcctgccggttggtcgtccctccaaatacacattgccgcagccggtctgccggatgtgtctcatacggcactttgtaggtttctttctggcggcttaagaatgacttgatttcctcaatactcttggcgttggctgtggcaatcatctccgacatctcgataatccaatgcccttgcagcttgcggtacacattttcatcgtccagctttttcaaatcgtctgaaaaccattcgtccctgcctgccagcagccggaaaaaggtagatttcccggctccctgaccaccaaccagacagagcatgacctcaaacttgctccccggtctgaatacccgccggatggctcccatcaggaacagtttcaaggcttcataggtgtattcgtccgtatcggctcccagaaagtgatgcagggcgtaacggatgcgctctgtgccgtcccattgcaggctgttcaggtaatccctgactggatggtagcggttttcattggcaacaatcttgatggcgctctgcacctttttctcgctggtaagcccgtaattttcttccagatacaaaagcaggtagttcatgtccatgtcggtcagcgtggtactggtgcgctcccagcccagcggcttcacaatgtcaatctgctccgtcaaaaggttcaggcgcagcgccccgcgaaacagagggtcacgctggaacaccgtcaggcagtttcggatgctgttcttcacgccgcctttctgcgtcccctctaatgtttcccggatttctgccggtgtctgcgccggttccattgtgtccatcgtccttttgaccgcttcctgcgtttccggcggcaagctctgaaattcgctgttcaagccgcaacacctcctttccctgtgcggcgatcaatgccgctttttcttctatttctccgtataacaaaatatccaaaaggtattctgtgtagcttatcctctgcaacgcttccacaaaaagaggatgccagatggcatcctgcggctgtggggcgtgtgctgttttccaatgctccagcaggcgcagataatcgcatagcacccggaaacaataccgttccgtttcctgaaatctctgctccgctgatttttgtcggggctgtgacctgttgtgacgcttcctatctggcggcgcattgccggatttctcataggaaacgccgaagtcctccgcaagcctgaccgcagcttcccgtttccccaatccatgcagcaaagcggcaaagtcgatcacatccccggaagccccgcagccgaagcagtaaaagcggctgtccactttcatgctgggcgtgcggtcattgtggaatggacagcagaccatgccgtttctccccacccggattccatagaatgaagcagcctgccgggtggtaacagactgtttcaccgcttcaaatacattcaaatgctccctccataaaaatactggtagcggtaaagctgccggttatatcatagctccatctcatgtttctttctctgtactgcctgtggctgctccctccggcgcagtgcggtatctacggcgttctgcacctgccgtagccgtatgacttcctcccggagtggcttgtgctgcggagacagttcggcatactctgtttttaactgtgcgtattcctgtttccatgctttcagggcaatgggttttccatccagtttttctttcaaaatacggcgggcggcataaaacagccgtaactccgcatcgtgggatgtttcaaatttctccctctgtttcttaaacttgatattgttcaattccgtatgaacaggttttagccgctggtaattctcgccctcccgtatcaattcctgcaattcctttatccgggcagatttctttttcatggagtcgcttaacgcttcaaattcttcgttgacagaggaaagacgctcctgcaaatcctctaatgtgagcagcttgttttccgtcagataattgacggcttcggcaaactgctttaagtttccggttctggctttattgctccatgcccctgcgttgcgctggttgtaataagcgatcaacaggtcggcaaggctcggtgtctgcggtttggaaagttcttcttttacctctgccatccagacaaacagggctttgatcttcttcctcacatcctgcatgagccggttggtggctttaatccagcggttcagttcccctttctcggtgcggatgccctttgcttccatctgccggacattagctccctcgtggacagtaggtatcaggtcaagcccctgccgcacataggaacggtggtcgatacgcacatccagccctttttcctcaaattttgtattaacggcagccgcccactgctcccgccagtgttccagcgtttccggctcatgccagtctgttgtatggacagcgttaaacatataatcgccgtttttatcccggattcggtttccatcttcatcaagaagatattcccgacgctgtttttgtccccatgtgccatccgggttcaaagggcgcatggttgtcatcacatgaaaatgcgggttagggatgccgccgtcctctttctccgggctgtgaaaagcaaggtcggcaatcatgccttttgtcacaaactgctcctgtacgaacttcctcgccagctccatgttttcttccagcgtcaattcattctgcatggcaatatcaaaggaataggcaagctgtgcttttggatgtttctcgcagttctccacagcattccagagggtcgcccggtcaagatatatttccggcgcatggggcggcagcatgatttccgaagcgatcacgccgccctttttggtgtagtcgctgacttctccatagtagctgctgtaaagacgctccccggctcgataggctgcgctggcaatggcgctctgaccggcgctgcgcttgatctgtgcgattgaaaaatgataaagtgctatccttagtcaccgcctttctcctgcccggaaatacgggcgtggttctctgtggcagaccggatgaaatgctccgcctgcggcagattcaaaatgctttccatgagggaataaaattccgcttcggatagctcctttgtctgtggtgcaatgctctcaatagctgccccacgggtaatcagccggtgcgtcctctgtttccgggaaccgctttccagatacgcctgccggtttttcaaacgctgcattttccgtttttcctgttccagcaggacagtggttttttcatattcctgcttcaactgttccaaagatttttccatgttctcacatcctttgctgataagataaagaaagaccatccgcagacagtccgtgtgtcagtgcttctataaaacccgatgaaaagggaaaaccgcagagcggatttctctttgcggcgggtacacaggggatagccgctttagcggcgcaagggggtgtagccaccttgtcggagcgaagcgaacgcagacctcggattgctgattttatcagcggcagaggtaagctccgcaggacgcacgatacatggtctttagactatgtatagaagtgcgcccttagtttctaagggattttgccgtttccggcagtcttgtcctttttcttggaacgcttggaaagatacttcgggcagtcaaccacaaccgcccggaagctctgtttacattcgtgctggcatttccggcacagttcgttgtaagtgatacggctgcggtcatttaagaagaaagaccattccaaccgccgcttgttactcattcttgccataaccggctcctttctccgtttctatctgatgtacgcagataggctgttttggtgtagcgtttcggtatcatttttaaggtttttccctctgtatacccctttgtaaagtgcggcagtatttgcagtcagggaatgataactcacgcttatttgtcgcttctcggtacggtttcggagccttttgccatccattcaaagaaagcaattttgctgaccttgataagtctgcccctgcggaacgctggaaagccgggtgtgtgtaccagctcataggcgctcgctcttgaaattcccataatccgctgaatgtccgccacatccagaaccagcggtaaatcctcgtagctgttcaatctctttttatcgttcattctgttcctcccataaatcaaataggttaaaatgcttcctgctgccgttctccccaaaagccgttttcctgccccattcctgcggtgtttccctgcattggtgcgccggatgcgtcacttctcctgccggtcatatcccttttggacggtcattcacttgtcaaggtactgtgtggcacgaaattaccaactgcaatcatcatagcggactatccttgacaaaacaatgcttctgcgataccatgagtgtaacagatataaccgaattatataattaccataaacaaaggcaggggatagggatggagaatcagtttatacggcatgagccatgttttgagaggattttgtttgtcctgacgctggacaggaagaaaatgaaagagcggattttgattggggaagaacagcagatccgcttccggctgaacgggagccaaaacgcagaggtgctttgtgatatgacacgcccactgggaacttttttgataaactttgagcgtgacacggacagagattggaacttatatgggctttctccgctgcggcaagccctccactccaacagatggaaacagccggagctggagcaggcggcaagcgaatttctctggggaaaatatcttagcaacgatcctctgaaaatgtatgtagcgttccgtatctggaacagctatctgcttgccagagaaccccgtgaccgtaacgctgcctgtgaccgcttcatggataaaatgagcagcctgaccggggtattccataacgaaaccatgatctttgacagagaaacaggaaaaccgaaacattttcaaactggcagcctttatttcaaaggcgcaccgtcagaagatacccggcttgacctctggttcccggacaaccggcgcacagaagaatgtgtgtctgcctatgcgtccctctacccgttgattacctattatctgaacaggctgaatgactgggggctttgcttccggcagtgcaaggtctgcgggaaatattttctggcaaagagccagcggtatgagctgtgcagcgacaagtgccgaaaagtacaggcgcttcaaaacaagcgggaatttgacgagagggcaagagaaaacaactatgacctgctttataaaaatgaatgccagaactggcgcaacaaaataaaccgagtaaagaataccgcaggctttccggctgaccgtctggaaaaaatacaggctgccttttccgactttaagaaagaagccttgcagagaaaaaaggctgtaaaaacaggaacggccagcccgaaagaatttacggactggctgtatcagcagagtaatgtaattgttgagctgaccgagatatgaaaaactttctatcgtcaatttcgcattattgcaataacagattgcttcttccatgaatggtaatattatcatcaaacttttggaagaactataaatgtccgaggtgcctttgatttcgacaaaaaaacaggctgaattgttacaaagctcggacatttcaaaagaattttttgaaaaacactaaagaagcggagcagctaaaatctgctccgcttcgatatgattgatctaaggatgttttgctatttgattaaactcactctgtcaaccgcaatcgctccacaactggaaggttaacgtcagttttgtagacccatataggcacaataaggcagattagcaacaccagtccagacaccagcaccagtgggataaatggataggagaaaacagcataataggccactttactaaaaatcatatatagcaagatgaagattgctgttccaatggtgactgcaagggaaagggaaacgccccaataatagaaaccttccataaatagcattcgtttgatttgtcgctttgtcattccaatgctttcaagaacagctaattcatagcgccgagtatttacattgacaaccattgtattgacaaagttcatgacaccaacaagcagcaggatcacggacaaccctgttcctaaaacctttgctgtaatgagatattcctgcatttcttctcgccgttcatatcgggatataatatcaatgttagcttgtgatgcggtgatttgctttaattcttgcagtatactttcgtcatgttgaccatccgtatcaaaggccacgcggaacactctatattgcggaaagagttctttcaaagctgtttgactaatatacaaatcaggagccgtccctctctcattgcctcctcctgctcgaaacccttcattcaaataaccgttcgctacaataaaggaatgctgtccgttctgcgtctggattgttatttcctgccccggctgaataaggtcttctactgttttggacagcagcacaacctttccttgttcaaaggcagacgtgtcaataggcaagtttaaggttttattgatttcttccaaatatgcactgtcaattccaaaaaccccactaaaaaagttttgctgataattttctaattttgccggatcagaaaaatcaatgccgtttactccgtctaatgacgcaagaaactcgtgaaatacagcatcgtcatatacaacatctgctactacttgaggataaggtgcataggtcaacctcaaattctcaatgccgtcaagctgaccaacctctgaaaccatttcgctggaaattaaatcttctctttcgtggatactatatgtgagtgcaaaatcgcttactccccattggctcacataattctccgggtttaaaccatgtaatagccctgtgacgacaaggaacaaggaaaggccgaaaaaaagcgatgcaaaaacaagggttgtactcttagcattacgaaagacattgttccatgccattctggacaacttcattttgctacaatttctggcgctactctttgtgctggctgctgtatattggagtgctgctattggtgaaacacttccggcaattttggcgggcttcatgcttgcaatcataacggtaatgaacgtaaatatggccgctcctatgaaaataaacggcgaaaaagatacttttgttcccacatcagaatttgttgaatacatcatattcaggaagtaaggaacaatgccaaaggaaacaaccgcaccaagtaacagaccaatcggaataccaatacaagagattctgattgcctgcttatagataattctctttatctgcctttgggtcgttccaatcgttttaagacggccatagaattgcacatcttttatgacagagacataaagaatattataaatcagcagatagccgctaaaggatataaaaactgctaaaattattacagctaaaataatagttccaccatttgcctgttctaatggtacaatttcaaatgtttgcccttctgtaaagtcaatctcacgccgcaatctttcacagtttttgtcagcattatcattgccttgaaaacggatcattgccgtaacactattatccagtgatacatttaagctatccttaaaagcggatgaaacataaacataaccacgattatttgtgcgcactggaatgtagtccgtatagtagcccgacagcaaaaaggtgtccgtgacataatcatagctatcgccaatttggtatgacaacacaatctccatccctatttgcggatcagaaatgcccatctgttcaagcacccatgtaggtagcataatttcgtttttacttgatgggtaatttcctacaacacctgatatagtaggaagacggtggtgttcccactctgtatcatttatccatactacacctaatcttgcgtttctcagttgttctgtatcaacactacctaaacgctgctgtatacctacgtcaaggacaaggtttgattttgaaatttcaaccaactgattttctgttacatttgtgattccgacatcagcggtagttcccattaaccgaatttgttgcatttggtaggtttcaaagtaactaaaaccaatactgaatgtcgcagttatcataaatgcagttagcacaagagcaatgattgcaaataaattacgctgccgttcacgatgcaaactgcgctttgccagcttcttttcaatgtcactggtatcattttcaaaaggccatgtcatagcttgccacctccttattccacaatcctgccatcctcaatgcggacaatccgatctgcaaggcgggctatgtcgtcattgtgggtaatcattacaacggtttgccggaactccgcgctggtgcgcttgataagtcccagcacctcggcgctggtcttgctgtcaaggttaccggttggctcatcggccagcacaatagccggtttggtaatcagagcgcgggcaatcgccacacgctgctgctgtccgccagaaagattattcggcatatttttcagtttatcttccagccccagcaggtgaacgatctcgtccaaaaacttctgatccaccgtgtccccgtccagctccaccggcaggacgatgttctcatacacattcagaataggaacaaggttatagttctggaagataaagccgatgttgcggcggcgaaagatggtaagctgttcatcgttcttctttgccagttcttcgccccggacgatcacggttccgctggtgggagtgtccagcccgcccatcatgtgaagcagggtggacttgccgctgccggatgttcccacaacggccacaaactcgccgtcctccacggagaagttcacaccgtcaagggcgcgggtaatgttcggctctgtgccgtaatactttttcagatcaatcgcctgtaaaacgctcatactcaaaactcctttcaaggctttctgcctgttgataaggctattgtaaaacccaaatgtccgcgaaatgttacagcggccaaaaaatttcattgaaaatcgggggtgaaatgttacaacgctcggacatttccgccgaaaaactgccactggcagctttatcggcacactgttgcgaaaagacttacggcgggcagccggaaatggccgtccgccgcgttctattttgtcggcagcataatggaaaattctgaacccttgcccggctccgaaaccactttgatatagccgccttgccgcgttacgatctcgcgggccagatacaggccaatgcccacgccctgctgttcgtgtacttcttcctcacgatagaagcgccggaagatggcagcctgattgctttcggaaatgcccttgccggtgtcgactactttgatctccacatacatttcccacagcaccactgacacggcgattttcccgcctgccggggtgtacttcactgcattgtccagcaggttaaagagggcttcggatgtccacttgctgtcatggaaaacggtcaaatcctccgggcagtccacggacacagcgatttcctttttctccgctgcatacacaatcccactcatggcctgcgccacggtatcaaagaggcgacccggcttcttgtctaactggatcacgcctgtttccagccgggaggtttttacaagggcctgaaagagaaagtccagcttatccgtctggctgcggattccccggataaagtcggtgcgctccgcctcggtcatgggcttttccagcagggtgtccgtcgccattttcagattgctcaccggcgttttcacctgatgggaaatatctgatacaagggtctgtaactcctgccgttcctcgtccacccggcggcggttctcctgcatgatctggtaaagccttgccagccggtgtccgattctagcaagctgggtttcgctgtcctctgggcgctggggcgcttcattcccagcgatcatgtggtctaaagtctggcacaggtcagcggtaaactgcgacagccgctttccaaacgcctgcgtcagtacaaaaatccccacaagggcgcacagcagcagcgccccgcccgtcagcagcaccgcaatctgttttgtcacaaaaaacagggctatggtgatcccggacatggagaggacaagccccattgccacccggccaaacagccgctttaccgagaggttttgaaacttcattttgcctcgcctcccgtccattgatagcccatgccgtaaacggtcttgatgtagggggggccgccatcagattcaatcttgctgcgaatccggctgatggaggttgtcagggtgtgttcgtccacaaacctttcatctatatcccacagcttttccaaaagctgcccacgggtcagcacttgccggggatttttgcggaacaggttcagcattttgtactccatcggggatagggtcaggggcttgccgtttagggaagccgtctgctccgagaagtccagaaacaaccgcccgtcgtcgtaaatgtccttggccggtttgtggtgttccagcatggcgaacatggctttgattttccgctgcaaggccccaatcacaaagggctttgtgatgtagtccaccgcgcccacctcataaccccgtatctggtcgctctcctgatcgttggcggtcaggaatattacgatggtgtccgggtgctgaggctttattagcttgcacagctcaaagccgttcccgtccggcaggttgatgtccagcagcactaaatcaaattcccgctggcggatggcgtcggctgcggttctggcatttagggcagaagtcacgccatagccgtctgcggtcaggttataggccaccatcttattcaaaaaactgtcgtcctcgacaattaaaatctgcttcatatcctcacttcctttgctttttgcagatagtataacaggcaaatgtccgagaattgttacaaggacaaatatatttatcattttacagcttttttatgtgtactgcaattttataaaagaaaggacagcagtatcatcaaattgctgtccttgcggtttattatagctggtagtgtataagcgtgggttcatcatatttggtgtggtatctttaactatgggaaactcccgtctcgtatttggaaagtgtctgcctggacacatcaatcttctccgccagttcctcctgcgtcattccacgcatcttccgcagcatcatcagattatctttgaacatgtttcctctcctttttctctccaatcacacaccatcttatgaccggaattctttttatcagctcatagagaagatagccgcccgcataggctgcaattcccgacaaaaggtaggctgcaacccccgtaactttggtgtagcggtccagaaaatatgccgccgccgagagtgccagatagtggaacagatacagtccgtagctctttttagaaagccacgctgtctttcgcgacgtacggttgccccagcgcttcattcctcccaggactgccagacacaccgttcagccatacaaaatggaaaacggactgtttaccaccggctcctctgcataattttccccaaaataataccgcacataaaaaactgtcagcaccacagccgcggttgcaagcgggacgctcacgcacgccagccggtcggtcacttttttatgggaaaagacatagtagcccagaaggaagcagatgccgtatattccgaaacgatacacacagatcaccggcgtattcaagatctgggcagctccccagacgggaatcacaagcagaaaaagaacgggcagcgcagctttttcaccaaacgcatacaaccggtctttttccattccattttttatgctttctgttaaaaatcattgcatttctcttatcatctgttgtacagacagaattccgtcagggattacatctcttgcacggatcatatccggctgcaatcagttcctccctgcttccggagaatgccgccttgttttccggcgacatctgcgcaacactcgagcaggatgaccggtgaaacttctttgtgttcgtattgagcacgtattctcctgtcacgtccgctgtgccgcccgcggcagtctctcccccggatgatgcctgtgccgcgcttcctgcggtatctgccgccccggatgttcccgtggtgtccgcagcacctgccgcgacctcatccccgtcccggtaatcctgcgtcgcgtccacgctccagctaagggaggttccgtcacttgtgaccgtgatggttccctgcagatccgtccggtagagcgctgccccgcatgccttcacccggtcgagtaccgtgcgcgtcggatggccgtaggagttccccgcacccgcactgatcacaaccgccgacggcgacacggcgcgcataaacgcttcggaggaagacccttcactcccgtgatgacttgccagatacacgtccgactccagcgtcacgccggagtcaagcatcgcctgctcttcggcttttccggcgtcaccgcagattaaaaagctggtgtcgccgtacacaaggcggattccgacggaattatcattatcctccttcggatcataggcttttgggcagaccaccgtaaaagaggcatcgccaagcgtgtaagtgtctcccaccgccgggtaggcaagtgcgatatcctgctcctttatcacgcgctcaaacgactcatagactctggtatccgtcacgtaatcgggagcaagcacctgcccgcaggaaaatgcgtgcagggcgccgaccacaccgtttaagtgatccgcatcgtagtgagaagcgatcacataggcgagttcttccacgccctgttccttcagatagcttaccacaaacgaggagtaatccctgttgccgccgtcgatcagcatatacgctccgccctgctccactaaaacggcattgccctgtccgacatccaaaaacgtcaccgacagcgttccgtccggcgtctgtccttcccccggctctgccatctcctctgtcggtgagccgccattctcctgctgctctgccatctgcaattccgacatctgaccatcctgcaaggttcctccggacagtgctgcctgctgccttaccgcctgcccgtccgatgccgctccgcatcccgacagcaaaagaagcagggccgcacaaagtgccgctgccccgcttctgattctgctgctgttatctctctttttcttctgcttccccgctgtctgcatgtcctttttcctcttccataaaatacatgcgcgcagcgaaatcctgaaaataccgcacctcattgttgtatccggttccgccgaacgcctgtttaagcttcactccatgatacattaacatatctccggctacatggcaatcctcgatctccccgtccatcttcttaaatctggcgatcagatccagcgccagcgaatcctgcttaatgtgtaccggggagacggtattgaccagatccccgaaatccttgatattgtattttaagctgcggttatagaaatggtaccgcgcatcgggttttaatcccttcgcgtgatagctgtgatactgggtattcggtacgaccagcttctgcatgagcataccgaccgcacgggtctggtcttccgacacacaggtccactccatctggttccccgcactctgggagagtacactttcatgtgccccctctccgaatgtgcgtccgcggtaaaaccgtcccttctgcaatacctcccgccactgtttgtacagtgcgatctgtgcctttaccgccgcaaaatcctcgcgggacagatcgcagaaattgcactcatagccgcagatgccgaatgccgccacggcgaaccgtgtctcaagcggcgtcacgcggagcgtctggtggttcgggcacgccgacacatgggcgctcacaacggacatcggatagccgtaggaatagccggtctgaatctccgcccggcagagcgcatccgtgtcatccgacgcccagatctgtggaaaataggataaaattccaagatcgaaccggttgccgcccgccgagcatccctcaaagagaatgtccgggaaacgcgcggtaagctctctcatgcaccggtacagtcccagcacatagcggtgtgccacctctccctgccgctccggcggaagcgctccggaatagtaatccgtaaacgtccggttcatatcccatttgacataggagatctccgccgaggaaaagacattcgtcatcgtctcgatgatatagtcctgcacttccgttctcgtaagatccagaatgcgctgattgcgtccctccgcgtgcggttttcccggaatctcgatcgtccagtccggatgtgcctgatagagatgactgttcacattcaccatctccggctccacccagataccgaaatccagcccgagcgccttgatctttcttccaagtcccgcaagacctcccggaagcttcttctcgttgacttcccagtctcccagggaatgtgcgtcatcattgcgctcgccgaaccagccgtcgtccatcacaaaaagttctacgccggcttcctttgccttcttcgccagagcaagcagctttctctcattgatgtcaaaataggctgcctcccagctgttaagcagcaccggacgcaccttgtgcttaaacgctccacgcacgatgtgctcccgcacaaatgcatgcatgcactggctcatgccattgtagccctcgcaggaatacgccatgaccgcctccggcgccgcaaagttctcccccggagccagcagccaggaaaatgactgcggattgatgccggcagtcaggcgcatcttgccgtagccgctcacttccgccgcctcatagtgattgccgctgtagatgaggttgcatccataacactctccggtatcctccgtcgtatccgtctttgcaatcatgacgaacgggttggcacggctggaggaggttcccgtgtaggacgcattgacatgttttcccgcctccatgcgcgtatcggagcggtgcatctccctcgcccacgcaccggtaaaggttgtaaaaacatactctgccggatcaaagtcgatctgggtgctcatcaggcgattcagacggaccgtctccccgctctcattgaagagaacggcgcttcgcacaatcgcatcgcactctgcgtagacatcataatgaagttccagcacaagatcataggaatgatcgcgcagccttacgctgagacgctgcgcctcccccttctcgtcgtaagctcccgggagatctccgttttctgtccccgccgtcttttctgtgatctcatagctttcatagcggaaatccgaagtggtgctgccatccgcgtgcacgatctccacaaacggttcgcggatgtccccttttccgtaggaggacatctcaagccgcatgtcctccagagagaacgccggatgctccccgtcgcagagattcgtatttcccggtgcaaatgtatgcttctccaccagcggagcaacatcacactccgccggatgctcaggcagcgtcaggtgccttccgtaatacagatgctccaaatgccctgtctccattctccggaagcagtatgtcgtatgcgccgtctccagcacaaaaatatgtccgtccgcttttatcatttagtatgcccctttcttgacctgctctgcgatctcggcaaccttctcctccgtcagaatatactttttgtggaaaatgaaaatgccgcacagaaggcagatgatcggaagaatcgtcattgtcatgcgcagacctaccaccgaggatgtggcagctgtcgcaactgctgcggtatctgttgtatcgttgctcagattgcagatctgtaagcagatcgatgcaatcagtgccgccacgccgctcgccagtttgaccacgaacgtctgcatggaaaagatcacgctctcgtcacgtctgtgatttttcagctgtccatagtctacggtattggcaaggaacaccgtcgtcagcactgtcagcacgccgtttgctgcaaagatgaaaaatcccgggataaacagcagtatcacgttggacatattggtgaatgccagtactaaaagcaccacataaccgatgattgccatagcaaatcctgtgtagaacacctggatcgttcccatgaatttgcgcagcagcgggaataagatcatcatggacagaatctgtaccgctccgccgaacgtattaaacaaggtgtagctgttgtaccagccctcgccgccgaagtcatatttaaagaaatagatcacaaggtttgaggtcgtatagaccgcacagttgatgagaacgatggtgatcacgaccgtcatcgcctggtcgttctgaatcagtgcacggaacatctgtcccacagacggagaatccacattgaccgtagatttttccttgacgttgacacatgtaatcgtcgtgaaaagtacaaataagattgcaatgatgagtgcaaaccacttgaatcccacgcgctcatccccgccgccaagacggtatacacataacattgtgatgatcgtgatgatggcagagccgacgcccgcacaggagcgcgccatcgtggaaagtccctcacgctctttaccgccctcggtaaacgccggaatcattgaccagtaagggatatccatcatcgtgtacgtcacaccccagagcacataggtgactgctgcataggccaccagaccgcctccgtcgagtgccggcggtgcagagaacatcaggtagagcatgatggcatttaaaatcgttccgatcaaaagccacgggcggaattttccccatctcgtccttgtcttggcaaccaccacacccatgatcggatcgttgaacgcgtcaaacacacgcgctgcaagtaagatcacgcccattgcaaacgcactcaccccgagaatatcctgataataatacagtatgtaacttgcggaaagcatgtacaccatgtcttttccgactgctccaagtccgtaggagactttttcttttcctgtcagtttcatgtgatcctccaattctgcgccttcgcgctccccttatctcttctccatcgcaagctctaccacacggtaggctccgtcgtaaattcctgctgccttgttcttctcgatgcagtcgcacatatcgttaagcagcgcgtcctcgtttaagaacagatccagcatctgtaccgtgtgcggaatatctctgcactctaacgtgccgtccccgatctctgcggagtggatggcgccccactgctcatgcccgccgacacgcttgataaacagcttcggcaccgggtagaatgccagctcgctcggctttgtcacaagcacatcgcagcttctcatcagaaggttcgtgcagtagactgcctcgaaaatattctcatgccagaagccgtggatgccgcttacctcaccggtaagtgcctgtgcggcaaactctgtcgtatccttccagttattaaaatgctccgttgcaaacttcttcattcccgggatctcgccgagcagctcctcccagacattgcggtaatcaccgacattcacatacagtgcggctctgccgtcccgaatcgcagggagcagatgtttaatgatggaagcaaaaatctctctctgtgctcccgctcctccgattgtgagaagaaaacgcatcggctttttctctctcttgcgcgcccgtctcgtctcacagtccgcctcgatgttgctcaccagctcatggtcgatgtaatgtcccgtatagatcagatcatcctcaggcatcgggcgaagaacgtcagctccctgcatgccgtttaagatgcggtagccctggtaggcgtaatgcgtctgcacggtgtgaatgcttccctccgataaatgcagcgccattggccagttgtccggaatcgcgttgaccacatgcttcattcccgcatggattgccgcctgcgccggccacacgtgtgtcgccaccaccggaatctccttcggcacattcgcatagaccggagccatcagttccgcgtttttctgatccgcggcattgtaggaaagcttccggaagccttcatagttcatcggctcccagaccagacggttaaacagtctgctcttctgggaaagtcttgatcccagggaatacagatcattctgcgcaccaataacttttgtgcaggtcgtctgcgggtaggaattcaagtccatccagtacggtacatagcccatggaatgtgccgcagatgcgatcgccatggaaatgcggtaatgtccgaatcccatgcggatgttgccgacgatgattcccttttccgtgtcaaatcccacgttttctcccgtctctcccacacggatgtcatgtacgtccagcatatcgccgatgtattcattcttcttcacgattgcaggataatctgcccctgcatcgtccccgaatttttttgcatatttctttttcgactttaccgctttccggtataccttatccggcatcggattgccaaaaataacttttgatttttcttccattgcctgtgttccctctcttctcttacaatctctgtcgctctgccgctgccgcaaagcgcagttccaccggttcggtctgtgcattccggatgacaagccgtgcctcaccgctctcacccgtcgtctttatataagtgccgcccattccgccctccagcgagatgacggacggtccgatcagctccaccggtccgctcacctcaaagcttaccggctcattaaagaagctaagcagattgccgtattcgtcccgcgcctcaatccggatggccgccacatcgtaggtgcttttctcctgaagtcctgtgtgatccgcccgtgcaaaaagtacaacctttgtcatcggctttttgatgagttccgcagtcacgccgccgtccgacaccgcctcaaaccggtatgtcgtggaagtgcctccccagtctccgatatagcggttatagagcaccaccgcatcggtcggcttcatgtgataaaggagcagcatcttaagcgccgtcacatacacggatttcggaagatgcgacagtccgtagcgtgcggtcgcattcaacgcatccttgattccctttccctgcgccgttgtaaaatgttcgtccttctcgatcgcatctccgatataatcgtcgatcacgagcggtccgtgcggcagatgtttccacggggaatcctctctcttgtattccttgataaaacggtcgtttttgtacatccgcacactgtctgcgttggtaaaaatgtaggtctcgccgcggttgcagcccgggtgctcccctatgtccatggaagaactcagttccagaaccgtatgctcctcctgctggcattcatagaccctcgccgccagcttcggattgcggaacatatccatcacgccgtggtaacagatgcggtctccgctgccgaaatccttgtgtgtgttgtagtcgaacatgcaccagccgaagcttcctgcaatgtcaccctccgcagccgccgcgtcgagcacccgcacatggcgcagcgcatgttccgcgcggtgttcctcccagtcgaatgccttggtcggatacatgtggccattgtactcgctgatcagatacggctttttcggatcggatgtcaccgccgcctttttctcacatccctggttcgtgccgtcatgcacaaaatcattgtaagtgtagacgtcttccagaagactgctctttttgtgcgcccgcacaccgcccgtcggtctggatggatcgagttcgtgcgccgccgcgttcgtcctgcggtaaaaatcatcatcgtcctgcgactcgttgatgcgcacgccccagagaatgatggacgtgtgattgcggtactgcatcaccatatcgcgcacatttataaccgcctgatccttccacgcctcatcgccgatgtgctgccatcccggaatctccataaataccagaagtccgattctgtcacactggtcgataaagtaatgagactgcggatagtgggatgtccgcacggcgttgacgccaagctcatactttaaaatatccgcgtccatccgctgcatggattccggcatggcatatcccacatacggatagctctgatgtcggttgagtccgcggagctttacttttttaccgttcagataaaaaccgtccgccttaaactcggcatgtcgaaagcctgtgaccgtcacattttcatccagcaccttttcatcctggatgagctgtgtgcacacctcatagcagaccggatgaacggtgtcccacggcagaacggattccaccgtatagtcgagcacaagctttgttccggtcagttcacattcgcccagaagacggtagccgctctcgccgcatcttttgatcttctgtctgacgctaagattctccccaccgccttccgccgtaatctcggagatcagtctgccggagtcaccggaaagatctccccgcacaaacacatccttcagataggttttctccttgatgtcgagccacacctcacggtagagtccgccgtatgtcatatagtcaatcacaaatccaaacggcggtatattcacgctctccctgctgtccaccttgaccaccagcgtgttgcggatgccgtagacggcatcgtcgctgatgtccatcgtgaatgccgtgtagccgcagtgatgttccccgatcttcttcccgttccagtagacttcgctctcatgcgccgccccgtcaatcgtgagcagcagacgttttcctttccattcttccggaatatagacatctctgcggtatccgctgaccatctggtaaacagattcgtcaaaatagtgaagcggtgtctcctttgccgtgtgcggaagccgtaccggaatcatgtttcccacgtcaaagccgtcgcctagcatttcttccgtaaattgctccgaaaacttccagtcgtcatttaaatatactctgttctccatgttctacctttgcctgtcaccttcctgcattgccacgcgtttatcccgccgcctccggcaccacaattccgtttaccagaatcgaaaccacctcatcgagcgcttccagataggaaagcccgctctgaatcaggatatctctctggaaaaactgttctaccgtggcctccagcatcatctttacgatcggaatgctgaccttgcggaccacgccttccgccattccctgctccagaagctggatcgttgtctcccagccggtctccagtcttttttccacctgcttgtagatcaccggatacttgtcctttaacagatagagctgtctgaaatccacatcccggtaactctccggaatcactccgagaatccgtctgatcttctccaccgtagagagcgcgtcatcctccacgatctgctgttcactctccttgatggaatcgaacatgtaatccaccatcgcaagaaacatcgactccttgtcgcggaatacggtatatatggtctttttgctcattccgaggattttcgccacatcgtccatggtgaacttcaggcctttctcattaaacgctttgatcgttccctccaggatcacttctttctgctgcatctttagccacctccctcttttggaaactatttttatttttctggtttcctttattctatcacgatttccaggttctcacaagaaaccgaatttacaaaatcagtttccattttttgtataaatgtactaaattccggtctttcaagcgcctgcgcgttcttgcaatcccgccgtacaatgggtataatatggttaattacagacatggaggacatcatggaaaacgatcatatcagaacgattcttaataatattgaaaacggaacgctcaccgcgagcgaagcctacgcgcagttaaagctggctccttttgaggatctcggatacgccaaggtcgatcatcaccgcgaagtgcgtcagggagcgccggaagtgatctacggagcctccaagaccaaagaacagatcgagggcatcacgaacagtctgctcgcccactgtccggagaatatcttaatcacgaggctttccccggaatccgctgcttacctttccgagcgttttacgctgttctacgatgaggcgtcccgcatcggcattgtgaaccgtacgccgcatatcacagcggagggaaccatcgtcgtagccacaggcggcacgagcgacattcccgtcgcggaggaggcagccttaacggcagaagtgctcggcaacaaggtcgtacgcgtctatgacgtcggcgtcgcgggactgcaccgcctgctctccaacatggagctgctctcatccgccaatgccatcgtcgccgtcgcaggcatggagggcgctctcgccagcgtcatcggcggtctcgtggactgccctgtcatcggcgttcccacaagcgttgggtacggcgccagctttcacggcatttccgcgctattgtccatgctcaattcctgcgccagcggcgtatctgtcgtcaacatcgacaacggcttcggcgcgggctaccttgcaagcatgatcaaccacatcggcggctgatcacaccatccatcactctaacaggaggtttcttctcactatgaaaacaatttatctggaatgtaatatgggtgctgccggagatatgttgatgagtgccctttatgagatctgcgatcagaaagaatggtttttgcacaagatgaacaccgtctttgccccttatcatatcgtgctttctccggaatccgccgtaagctgcggtatcaacggaacccacatgaaagtaacggtggacggtaccgaggaggtctctctcgatgtcaaggcgggacatgcccatcacacgcatgcagagagtccggatgcatcctttgcccacgaagcgtccgattctgcggaggacggacactcccacacgcacaccacctacgccgccgtctgcgaggagatcgcatcccttgatcttcccgcagaggtaaaggacgatgcgctcgccatctaccgcctgctcggagaggcagaagcaaaagtacacgacaccacgttagagcagatccattttcacgaggtgggaacactcgacgcactcgcggatgtggtcggctgcgcgcttttaatccgcacgatcgcaccggagcagattctcgcgtcgccccttcacgtcggaaacggctttgtaaaatgtgcacacggcgtgctgccggttcctgccccggcgaccgcagagcttctgcgcggcattccgttctacaccggctccgtgaccggcgagcttttaaccccgacaggtgctgccatcctgcactactatgtgctgcgctatctcccgatgcctaccatgaccgcgtcggagatcggctacggcatcggctcgaaagatttcggcatcgcgaactgtgtccgtgcttttctcggcgacaccgcctcctatctcgctgccgaggaggaggagccatactcctgcgacgataccattttatcgatctcctgcaacatcgacgatatgaccggcgaagcgctgggacttgcaacggagatctttatggcagccggggcactggacgtctttacaatcccgatccagatgaagaaaaaccgtcccggcattctcttaacctgtctgtgtgagatggaggaacgtgaaaaattcacagggcttttcttcctccatacttcgaccagaggcgtgcgctaccaggtgttcgaacgcgcaaagctggaatctacttttgagacgcgcaagacctcgtacggcaatatccgcatcaaaaaaagttccggctacggcatccagaaggagaaagcggaatttgaggatttaaaatccgtggtcttaaagaaccactgcgccctctctttgaatgaaatcgagaaatccctgcactaaaaaacgtgcgggagactgcacataccgcagtctcccgcacgttttttgtgtactgtaatgaatcccagtctacagattttcctcttcgatcgtaagcatcccggatcttaccgcaagttccacaccggggcacttttccttgtactgctccatcaaaagcagccagagctggtgaatgtgatccgcaagcaccgccgacatctccacactgtacggcagtaaggtgtgaaggtcgaaaaagcggattccctccggcggcagaaagaccagattgcttgagcgctccttatccccggatttcttgagcagctcataggtaatcatgcagaattcttttccgcggtagttacagctgtaagacgcataacactcatcaatcgtccactttgttccgtgctcctcctcgatcggcttctcggaagcatcatttccctctgtggtctgtacttccagtctccaggaaagcttctgtgcttttgtctccgcaatcatctccgtcagtttacggcataattcttcctgtttcatttctctacctccgtattctcccagcggactgccttcgccttctgcaatgcttccggccgctgtgccgctaccgccgcttcatccgacgcatggcggtccagccagtctgcataatacccgacagcctcttttgtgctgtcaaactgatacagcaggggcttcctgccccagtccgccacatagacccggttatagtccagatacgccgccaccgccgtctcaccggtgtcacggtgcctgtaacactgttccatcaccggttcgccctgcacttctttcagtccggcgcctttgatcttctgctcgagttcttccaccgaatcaaacagtgaaaataactcaagctgtccctcaacattcttccctgccatagccttcctcccgcacaagcccggatcagccccagattacgctctcacatagatctcggacaaattgtccagaatctcgcccgcgacatccggcttattcatagtatagatatgtacgtgattcacgccgttggcaatcagatcgataatctgatccgtcgcgtaagcaattccggcctggcgcatcgccgccggattatccccgaaacgatccacgatcgccaggaaacgcggcggaaccatattgccggaaagcgacacgatcctcttgatctgcgccttgttcgtcaccggcatgattcccgcaaccaccggcacatcgatgcctcttgagagtgccttgtacaggaaattgtacagaatgtggttatcaaaaaacatctgtgtcgttaggaattcacagcccgcatccactttttccttcagatgatccagatcctcaaaaatggtgtccgcttccggatgtccctccggatagcaggcgccgccgatgcagaaatctccctgtgctttgatgtccgcgatcagctcactcgcatgacggtactggttcggaagcgggaaatccgcattctgcggaatgtctccccggagcgccagaatattgctgatctgcttctcttttaactcctcaatcacggatgccaccttttccttcgtggaggaagcacaggttaaatgtgcaagcgccggaatctgatgcttttccacctcgctggcaagttctaccgtatagtcggacgtaccgccggtcgcgccgtaggtcacgctcatatatgccggcttcaatgccgccatgtccgcaacgatatttttgtaattggcaagctgcgccccctgtttgggtggaaacagctcacaggaaatcgtaacctgatcggtctttaataattctgtccgtctcatctgctctatcctttcttctgcgtcatgcctaaaattttctcagcttgtctgttccgtcatccacggtattctcgatcttgcggattgtgacaaaataagaataatcatcgttgacccgcacttccacgcgatcccctacccggtgtccaagcagcgccttaccgagcggcgactcattgctgatcaagttcttgagtgaattgccgcgcacggtggtgacaatcttatagacttcttcctcatcgtcctcctcgaaatacacggtgacggtgttattcattccgacttcgtcctccgcggaatccgtagatatgatcttcgctgtcttgatcatcttctccagataacggattctgctctcgttctggttcttgtctttttttgccgcatgatattcaaaattctcgctgagatctccctgggctctcgcctccttcacagcctcgagtgcttccttgcgcacaaccagcttgcgatactcgatctcctcttccattttcttgatatcctgctctgtcaattcatcgtacatgatctatccccatcctttttggctgatgaatttattatagtgattttaggaaatgccgtcaaataatttccgcagatcaacgttctgcacaggacaccccgtgatgggatgtcccgtgcagaacgacaatacataatcttttgcaaatgcttctgtatacaaataaaagtccccggcatccgcctccctgcctaccgtctctgtgtccgatgcttcccggcctgccacctgatcctccagcacatcaaaagaagaaagcggcaggtgcagtccttcccctaccgctttgcaatagctttccttgcgcgtccagagtcttaaaaacgcatccggtttgctccgcagatacgcattctccgctgccgtaaactgcctttgcataacattcacattcacgcgccgcgcccgttccacgtcgatgccaaccgcgccgtcgtcaaataccgccgccgcatagtctcccgcgtgggacaggttaaaatgcacccccgtcccgccggaaagttccggctttccgtaggcaccgcgcaccagatgcaccgtctctgtccctggcaccagcggaagcagggaacagccaagacttcgcagaccatactccagcaacaaacctgcgccaagacttctcctgcgatcctcctgcttcccgcagcgcgctattttctcctgtctctctgcgggtacataccgcagaagctcttcgtacaatgccgcatcccgcagcggcgaaatattggttatcagaaccctcatgccgtctcctttaacagggtattcagcctgtctctcgccgccagaagttcgtcgcaggcaggtaaaagtcccgccgtctctcccgcacgcagcggttccacaatccgcaccacaatatcatataacggggtcagtcccatattggcaagcattccttttaatgtatgcgcacattcaaatgcacgccccatctcccctgagcgcagcgtctccggcagaagttcaaaattctgatctgtcgctgccgtgtacaggcagcggcggtacagctccctgtcaccgatgaaccgtgccagcgcaccgtccacatcacagccccagtttttcaaggaatcaaacagttcctccattgtccgtctctcctttatccttctctccggcaacagacacccgcttcaacagtctgccagctcccagaacattttccactctgcgcatcgcaatctccggcacgaaaggcttcacgatgtagtcctctgcgcccagctgcagcatctggatctgatgtccggtcgtgtcgtccgctgtgatgataatcaccgggattcccgcaaggacggcatcctgctgctttcgctttaggaattccattccatccatcaccggcatcgcaagatccagcaggataatatccaccttgccggactctctgtttaagacctcaaaggcatccgctccgttttccgcttcaaggatccggtactgttgctcaaaaatgcacttaagcagtccgcgatttacctcctgatcatccacaaccagcatcgtccgctctgtcttttccgctgccagaagtacctgacggtatttctgcagttcctgatccatcatccgctgttccgtaatatcggtaagcgtaccgacgataatgtgcttttcgcccacgctcgtgatgtatttcagcttcagatgtacccagatcgagcgtccgctcttagaagtgcgcaaaaattcgcaggctgcggtctccttcgactttgcaatatcctcaaacgtgccgaggagaatcttcctactctcgtccgagagttgtttttccatcacaagcccgcccgaggaattgatatctccgtatccgaacatgtcatagtaggcgttgttcacgcggagtgtatcaatccggttctgctctttctcatattcatagatgaccgccggctccatcatgccggaaaatacgcttcccatctgtgacgtcgcgttccagagcatatccctgccgatctcgtccttctggtacttctcctgcagttcgtcctttttctcggataccagcttttcatagtcggataccggcatcggtctcgcaaaataaaatccctgtacatactcgcatccgacgctgtgcagaaagtccacctgctcccttctctctacaccctccgcaatcaccgggagattcagccattttgccatgcgcacaaccgacgcgagaatattctggctacgcccctcctgatccgtatccgacagaaacttcatatcgatcttgagcacatccacggcaatatcctttaacacatttaaagaagaatatccgcttccgaaatcgtccatcagaatagaaaatccttccttctgcagacgttccatcgtctccttgatcgccttcgggttcgtcgtgtaggcgctctccgtcagttccagttccaacagttcccgggggatgtggtagcggtccgtcagtccgcagattgcctccaccagtcttggattatagaggctgaccctggaaatgttgaccgacaccggcgacggctttttcccctcggcaatccatcctgcaagcagcttacaggtcttctcccagacgtagtaatccagcttggtaatgaatccattgcgctcaaagaccgggataaattctcccggcgagatcatgccgccttccggctttgcccaccgcaccagcacttccgccccacagatcctgttgtcctgcaggctgtacttcggctgcaggtaaaggacgaattcctcctcgtccaacgcatgccgcatatggttgacaatctgctgttcccgcacgatgtcttcccgcatctcatccacataaaacgcatagttttcgatgtaattgcctttgcactgcttggcagccagattcgcccggtcatacatcgcatcaacggagagatcccgctcccggatcacatagattccgattgccggcaccacatcaaaagcgagctggtactgtccgagacgcatgcgcatgtagcgcacaagctctaacatcgtctcctcgcccctgtacggcatgcagatgccgaaaatatccgcctcgattcttccgtaggcaatctgttccgtatctcccgcaaatttccggatctccttcgcgatatactgtaaaagtccgtcaccgctgctgcttccgaagaaagaattcaccagttggaacttttcgatgtcgagacgtaaaaacgcatacgtctcttcgggatgtctcttaagcagaacacgggttgcttcaaagaaatgcgtcttattataaattccggtgagcatgtcgtaatccgcacggtatctcaattctctcgacagctgctgttcactgctgcgcaccgcattttctacccggaaccgcacgatctgcggatcatatggttttcctataaaatctcttgcccccagtgccagacatgccttttccgtcttgacgtcacgctccacagacgccacaatgaccggtatccgacgataagaatccaccttgcggtattctcttaaaaattcaaacccatccatctgcggcatgaccagatccagaatgatcgcagatatcgcgtcaaactccttctgcgattccagaatccgaagtgcacctgcaccgtctactgcctctacaatctcataagcatcctttagcatctttttcaatgcgatccgatccagctctgaatcgtccactatgagtaccttatctctgctgcccatactcttaccccggttttttttattctcctggttcctatccgattcgtcctatattcctaatctgcattcgtcatcaaacgcatcataacctcacttcatcatagcaaagttaccgccgcatttcaatacttcgggcaaaagaagcaggaaaaaagccctacccgctattgcggcttctctatgacagcaatcgcctttttgaactggaagaaaaacagaacaagcgtaaagcttaccgcgatcacatccgctgccggctctgccagatacacgcccatggtctgatttttcaccagatgcggcagcagataaataagcggcagcaacagcacaaatttacgcataatcgccacaatgatcgaagcccccgcattgccgatcgagataaatgtcatctgacatgcaatctgcgccccgaaaatacccatggcggcacagtagatgcggagcgcccacttcgtgtatgcgatcagctctgcgttggaggaaaaaatcattgcaaacatctgcggaaacagcatgattaaaagccataccgccatcgaatagcacaggcttgtggtcaacagcagacggaatgtccttttaacgcgctctgcatttctggcgccgtaattgtagcttgtgatcggctgggcgccctgtccgagtccctgcatcggaagcatggaaaactgcatcgcactggatagaatcgtcatggctcccaccgccacgtctcccccgtatttgagcagcgaggcattgaagcagaccgtaatcacgctctcgcttgcctgcatgataaacggggcaagtccaagcgccagccccggaagtaccacgcccgcttccatgcgcagatactttttgcggatttttaatacagtcttttttcccgtcaggaatgagagaacccagacggtcgataccgcctgcgagatcaccgtcgcggtcgccgctccgcggactcccataccgaatccatagatcagaaccgggtcgagcacaatattgcagcccgcgccgatcataacgctgagcattcctgtcctggcaaagccctgcgccgtgataaacgcattcatgccgagcgtcagctgcacaaagaccgttccggccgcatagattttcatataatccgaagcaaagccgatagtattctcacttgctccgaacgtcagcaacagcggtctgtaaaacagtaacagcagaaccgtgagcacggcggagatgacaatctgcagtgcaacgctgttgccgagaattttttccgcctcgtcatagtcgccctttcccatcgccatggaagccctcggtgccccgccgttgctcacaagtgcggcaaatgccgacacaatcatgataatgggcaggcagacgcccacccctgtaagtgccagcgccccatcttccggcatatgtccgatatagacccggtctaccaggttatataacaggttgatcagctgtgcaacgatcgctggaagcgacatgcgccacagcagtctcccaatcggatctctcccgagaaaatcatttttttgttccatatcaacggttcctcccatcatctgtctgtatcaaaaaacatctcgtccaaatataattcgttgaatttcgggtgcatggcaagcgaaagttcctgtgcgcgccctgtgatagacgcaagcctctgttttgccgccgtcctgtcgtcgagcagataccgctgtgctcccgcaagcgcactgttgccaatcatcgtgatatgtccccggaattgttccgggaacagtccgatccggatagtctgctcctcgtccatcctgcagccaaaacctcctgcgatcaggatttcttcggggtctcctccgccgtattccgcgagcagcgtctcgatccctgcgcggatcgccgccttgcccatctgcacctgtctcacatcctcctgccggaaccggaatctgccctccgcgaccggcatgccgtccgtaaaccagggttcctcaaacgtcccgttctcatcgatgagtccgagccgcacggcttctcccacagcgtcaataatcccggttccgcataagccgatcggtgtctcaccagcgatggtgcttaactccacggttcttattcctcctatggcggcaggatctctctccagaaccaggcttgtcacggctcccggaacgcccgcaacaccgcaggatatattcccgccctcaaagaccggtcccgccgctgcggaagtcacaagaaatccatccgctcccccggctgccatctccccgttggtgccgatgtccagcagcaacgcatttttcttccggtccatttccaaggcatagattcccgccacgatatccgctccgacgaaagcagagattccgggcaaaatggtcactgacacactccaccggtcagacagtgcaagctctgcatcgctcccctcccagagagagagatcctcaggcgtaaaaggcgccgctccaagccccgcacaggataatccgcgcaggagatgacacatggtcgtatttccgacaatcacaagttcctccacagcatcatccggtatcccggcatccgccacgagtcccgcaagcagcgcatcaatatcccggcagatgctaaggcgcagttcctctgccgccccctcgtttgccgcctggattctggacagaacatccgcgccgtatgcccgttggtgatttaccgaggatgcggcggcaatccgtttcctctctgtaaggtcataaagcgttgcagcgagcgtggtggtaccgatatccacggcagcgccgcagcgctgtttcccggaatgcccccatatcttggctgcaccctctctgttgtgcatcgccgcgcaatctctctcaccagggatggctcctgccgtctgaccggtattttccccatccgctgcatccgccgtgaccaacacatcaatcttctgctcccggcttacgggaagctgcaggctgcatgcctctgccccgcacacttcacacgccatgcgcacgccactgcttcgttcttccgctgtgagcagcctccgctcatttgccgtcggttgtggtgcctccgacacaaagcgcacgcggcatcttccacaggttccctttccgccgcagggcgcatccacataatgtcccgctcttatcagacgcatcagcagcgtctctgccttcccgcccgatcctgccggaagttctatcacttcttttgcatattgaacgttcatccagtcattcctccccgcgttatggcgtgtagtccacgcctgcccgcctcgcctgctcttcctgttcctcctccgcgatccggtatatccggttccctttccggaaaaaagtgccggtccgcaaaaagcggaatgtaaccccgcagttcacgcactggttcatcagttccagcgcccaggcaaaatcgcatacacgcgcgtctgctccctgttcgccgccgcagagaacctgcgcaatctccccggtctttagatacgcatccagcaccagtttttcaaggagcggttcgcagagaattcccttatggcgcaccggcagttttaaaaatgcaggaatccggtcatccgcgcgtctctgaatctccaccgaacagagaatcgtcacgttttcatagccgtctccccagtcgccgggcagtgctttaaaaaagcggtgctccctctttgtctcaatcacaaaggaaagatcctgccgctccttgatcatcgcccacgcctcgctccgccattcatccgcctccggcaggaaaaaatccgacgtcatgcacacatagaccggttcctcctgtggcagcagcttgtattctcctctccggttcttctttaccggcagatcaaaattggctgtccttcggatcacggacgcatttttgccgtacatcgcatctttttcatatacataacagttgtcgcaccctgcactgattttcttgcagccatgccagggattccagaccgccatacgaaacgcgcctccttcttctttcctttttgtccgccggatggtatacttatcacaaatctggaaaaagtaaaaccgctgccacatccgggcagccacagaaaggaattgtctatgaaactgatctcatggaatgtcaacggtctgcgcgcctgcatgcagaaaggcttcgcagaattttttacagcaagtgatgctgatattttctgtatccaggaatccaaactgcaggaggggcagattgattttgcaccggagggctattacgcttactggaattatgcgcagaaaaagggctactccggcaccgccatttttaccagaaaggaacctctgtcggtgcattacggcatcggcattccacagcacgataccgagggacgtgtgattacgctggaattcccggatttttatatggtcacctgctacacgccaaattcccagaatgaactggcaaggctctcctaccgcatggagtgggaagatgcatttctctcatatctaaaaggtcttgaccggaacaagcctctgattctctgcggcgatctcaatgtcgcccacgaagagatcgaccttaagaatccgaaaaccaaccggaaaaacgccggttttaccgacgaggagcgcacaaaaatgacggctcttttatccgccggcttcaccgatacgttccgccatttttatccggataccgagggcatctactcctggtggtcctaccgctttcacgccagagagaagaacgccggatggcgtatcgactacttcatcacctcatccgcactcgatgaccgccttgtggatgcaggaattctcaccgatgtcactggctccgaccactgtccggtaacacttaccgtcgatctgccattctgtccatagcactatttctgccgatagacatgacagtaaagcacgtcccgcatggtctcaaattcatccgccaaaagccgcttcggataagacatgatccgaagcgggatggcatgtctgtcctctcccatcgccggctgcatatattcaaacggattcatcacgaatctgtttctctcataaaatgcaatccgtctggcttccagttcaccggtcggcagttccacctccagtataaccggctttctgctctgcgtcgtcagctgtgtcagaagtaccgctccaagtccgccgtttcggcatgatttcctcacggcaaagtgctccacaaacaggaatgtatcaaactcccacactgccagaaacgccatcagttccccatgtgcacggtacccgtacaggtgataccaggagacatccagtatctttctctgcgcctccctggatcgtctctcgtcccgcggaaaactctcctccataatctcccatacgctgtcaaaatcccgttctgtcagtgtctctaaactctgcatgttctctctcccggctgattctttcttacttacttttataccataaaacaagattatagcacaaatttcctacggaatcaaaccgcgctgttctttgcctgcgtctcaccctctccgatcctgatggtgcggaagccctctccgtgcacttcattggactccaatataatcataaacgatgccgggtctgcctccttaacagcatgctgaagcagatacatctctttgttgttgcacacgcacatcacgacctgtttgttgtcacagcggtaaccgccctgtccctgtaatatcgtagagccgcggccgcagcaggaatcgatcacatcgcagatctcctttccatgctctgtcacgacaagtgtcattttcccggaattgatgccgtacatcagcttgtcgaccacgattgccagcagaaaactcacaatcattccgtagataattccatccacatcccgaagcagaaatccgcccagaagaatgatgatcacatccgtcacgaacgaaattttcccgacagaccagtatggtttcagattcttgactgccataataataaagtcggaaccaccggtcgaggaattctgcatgtaaatcaccgcatatcccagtccggcaaacacaccggtacagagtgccgcaagcagacggtctcccgagtaaaccgggagcagcggcgcaacatagtcaatcatcagagaagaaatcagcatacagcgcagtgagctgaagaaaaaatgtcttcccagcagacgatagcataatattgccaccggtatattcagcagtatcgtggaaaatccaaccggcacaccgaacagctgatataaaatgatcgagataccggaaaatccggtcatcggaaatcccgcctgcaccgcaaaattgtaaataccgccagcgataaacgcacttcccacaacctcccagaatatctgttttaaaaatatctctctatcttcttttttcattttcattcatccttcctttgcatgcgagtgtctccacaacacaaaaaaagagcaccagcagattatacgaatataatatgctaacgctcttttccgtatcctattgtaacaccggaatccggaatttgtcaaatatgtttctctttacaatccgtatgtgtcgtgttaatatacttcacatatgaatcattcatatttgaagtatatatatatgcaagacatatcaatatgaatattacatgcgtgaagtattattttatcccattgaaaggagcatttacctatgaataccggtattgaatttaccatgaaactatcggctgcctacagtgctgtatgcagacctttgtgtcacgaactgaatctcccacagaccgcgttcgatattctgatgtttctggcgaacaacccagaatataccaccgcacgcgatattgtggaagtccgcaagatcaaagccaacctcgtatcgatcaacgtagacaagcttgtcggtgaaggttatctgcggcgtgaggcggacacagacgaccgcaggaagacccatctgctctgcacagacaaagccggcgctgtcatcgaacaggggcgcacacttcagaaccgctttatgaacagtcttctggcgcacatcgacgacgctgccagaaagcagctcgcagaaagtattcaccagatggagcagaatctggatcacatgttagaggaggaacactgatatgacattattattcacgatactcgtcaccttttttgccggcatgggcgccggactcggcaccggcttcgccggaatgagcgcagccgccgtcatcagcccgatgttaatcacttttctggatgtcgacccctatatggcagtcggcatcgccctctcctccgacgtgcttgcaagcgccgtctccgcctacgtctatggtaaaaacaaaaatctggatatccgcaacggagtgattatgatggtgagcgtcttaatcttcaccgtcatcggaagctacatctcaagccttgtcccgtccaccaccatggggaatttttccgtcttcatgacgtttcttctcggcatcaagttcatcgtaaaacctgtcatgacgacaaaagaatccatggcgcaggtctccacaaaaaaacgtgccatccagtcggttgtctgcggcgtgatcatcggatttatctgcggtttcatcggtgccggaggcggcatgatgatgctcttaattttaacctctgtgctgggctatgagttaaaaactgcggttggcacgagcgtatttatcatgactttcaccgctctcaccggagccgtgtcgcactttgccatcggcggcgctcccgactggacaatctttcttctgtgcgtggtgttcacgttcctctgggcgagaatcgcatccgtattcgccaataaggccacaccaaagacgttaaaccgtgcaaccggtgtcattcttgtagtccttggcatcgtcgtgctggcgttttccttgttgtaaaatctgcaaaatagcagataaccagaatatgcttacaaatatgccgaccggacgctggcagcttcccaccgccgccagcgcccggttccccgcaaatctcccggtcacagccatacctgcctgacatctttaaattcggtgccgatcatccagtctctcacaattcttggaattctccacgcataggccggtgttacaacaagaagatatcgtcctgcagggcattataaaacctgagacgtacaaatacaagagtgcgcaacgccagcttttgtacaatccataatcattttctcacacatctcataccccagcctggagctgttcatagacagtgtataattgcccgccattccccatttctgctccgtgtaaaaacgataatttgtcatacgcctcttatcaatatccgccatcattttagctgcctcgccttcgttgacatggtacagtctgcagatgcgctgcactttttccggcatatcgccgtgtataaatacattcagcacatcctctctgtccttcaaaataaaatctgcatttcttcctataatgacgcagctctccttttctgcgatctccagaatcacctttctctgcgcttcgtacaccatatcttccacggattttccggtaaggtcgcgtccggcaaaagcatagccaaacaaacccttctttggagagagttccgcattttcctttatgtactccgtagaaaatcctgacttctctgcaatctgaccgatgatatccttatcgtaataggcaattccaagcttctttgccacttcttcgccgataaaacgaccgccgcttccgaattctctgctgattgtaatgattctttttgccatctcaattcctccctaacttaaacgctccactttattttttctgattctctttaaaaatacatagcccaccagacacgctatcatctccgtgatcggaaatgcccaccagatcagtgagatgcccatctgaccgtttcttgcaaagattgaaaaaattcctgccagcggcaatatgatgacaagctgtctgagcagcgaaatcaccagtgactcgatacctccgtccaaagcctgataaatgccctgatatgccacattgattccggcaaagataaagctgatggagataatccgcatcgctccaataaaatattctctggattgcccggcattaaacagtgtcgcaaatgctcccgggaacacttccgtgataatgataccaaaaatcatcagcgccgttgtatacaggagaccatattttattccgtccttgattctctttttgcttcccattccataagcaaaagcaataatgggtgtaattgcatctctgagtccgaatgctaagaacaacacaaactgctggactttatagaacagtccgtatgcggtctgtgcagaagggctgaacttcagaatcaagttcatcacataaaccatgatcgacatcagcgcctgcgcaatgattgccggaagtccgatcgcatagatttcttttatgataccggcatccggcttcatgtactccactccatgctcaaattcctgattcaatttcatatggaacaaaaacagcaataccgcagacgccacctgaccgatcaccgtcgcgtaggctgcgccttttactcccatttcaggaaccggtccgataccatagatcataaccggatcaagaatgatattgatcacggctcccacaacctgaccgatggtcgaatataaagaacgtccggttgcctgcaataacttttcaaataaagaaaagaagataattccaaaggaaatcacgcagcatattctaagatagcttgttcccatcgaaattacttccggatcaaccgtctgtgaggaaatatatgccttcactccggcaattccaaacaacaggcatactgcataaatgattcctccgaggaataaactgttgcctgcaaccttcgctgccttttttgtatttccctgcccgagtgtccttgccaaaagtgcatttgtccccacacccgttccgattccaactgccaccataagcatttgaaccgggaacaccagcgtaagtgcatttaatgccgcctcactccccactttcatgtttccgacaaaggcgctgtccacaatattgtagacagcctgcaatgccatggataagatcatcggtattcccatctgcaccataagcttctttaccggcatttccttcatcttgttactctctgtcatataatcctccttgtttttccgcacaaaaaaaatgtgtacctatctcataagctggacttacgctgataagctacacacttctttatggcatgatatttattttaaaaacagaaaaacgagtagcaaaactggatttacgctagtctgctactcgtttgatccttattatatttctcattttagaaaaagtcaatatagcaaaagcgcaaaaggacagccacacacatacatgtgtgactgtccttttccctatctatacattaccttctcctaaaaataacgcatatgatttatttgtttgcgattgctgcctgtgctgctgcaagacgagcgatcggcacacggaacggtgagcaggatacataatccagaccgatcttgtggcagaactctacggaagaaggatctccaccgtgctctccacagatacctacatgaagcttcggatttaccggcttgccaagcttgattgccatatccatcagcttgccgacacctgtctgatccagttttgcaaacggatcgttctcgaagatcttggtatcatagtaagcatttaagaacttacctgcatcatcacgagagaaaccgaatgtcatctgtgtcaggtcgtttgtaccgaagcagaagaaatcagcctctgttgcgatctcgtctgcagtcagagctgctctcgggatctcgatcattgttcctacttcatactcaagctttacacctgctgctgcaatctcagcgtcagcagtatcaacaacaaccttcttcacatactttaactcttttacttcgcatacaagcggaatcatgatctccggctttacagtccagtccggatgagccttctgtacgttgattgctgcacggataacagcctttgtctgcatctttgcaatctccggataggtaactgcaagacggcatcctctgtgacccatcatcgggttgaactcatgcagagaagcgatgatgttcttgattgtctcaacagacttgccctgagcttttgcaagcttctcgatgtcagcttcctctgtcggaacgaactcatgaagaggcggatccaggaaacgaatggttaccgggcagccttccagtgcttcgtataacttctcaaagtcaccctgctgatacggaagaatcttatcaagggcagcttctctctcctctacggtatcagagcagatcatctcacggaatgcagcaattctgtcttcctcgaagaacatatgctctgtacggcaaagtccgataccctcagcgccaagctcacgagctttcttagcgtctgccggtgtatctgcattggtacgaacctttaatgttctgtacttgtcagcccatgccataacacgtccgaactcgcctgcgatggtagcgtcaacagtcttgatctcgccatcatagatattaccggttgtaccgtcgatggagatccagtctccctcatggaactctttgccggccagtgtaaacttcttattctcctcgtccatagcgatgtcgccgcatccggatacacagcaggtacccataccacgtgcaactacggcagcgtgagatgtcataccgccacgaacggttaagataccctgggaagccttcataccagtgatatcctccggagatgtctcaagacgtactaatacgaccttctctcctcttgcattccaagcctctgcatcctctgcagtgaatacgatcttaccgcaggcagcaccaggagatgctccaagacctttgcccatcggtgtagcagcctttaatgcagcagcatcgaactgcggatgaagcagtgtatcgaggttacgcgggtcgatcatcaatactgcctcttcctctgtcttgtgtccctcatctacgaggtcgcaagcgatctttaatgcagccggagctgttctcttaccgttacggcactgtaacatgtagagcttcttgttctctactgtgaactccatatcctgcatatcatggtaatggttctcaagagtctcgcaaacctttaagaactcagcgtatgcctccgggaactcctgctccatctgagcgatcggcataggtgtacggacacctgcaacaacgtcctcgccctgtgcattgattaagaactcacccataagcttgttctcaccggttgccggatcacgggtgaatgcaacacctgtaccagactcgttgtttaagttaccgaataccataggcattacgttaactgcagtaccccaggaatacgggatatcgttgtcacgacggtatacgtttgcacgcgggttgtcccaagaacggaatacagcctcgattgcaagctttaactgctctacaggatctgacgggaaatcagttcccagctgattcttgtactcagccttgaactgctctgccagagtctttaagtcagcagcggtgaggtcgatgtcgtactgaacacccttctcctctttcatcttatcgatgagctgctcaaaatacttcttaccaacttccataacgacgtcagagaacatctgaatgaaacgtctgtaggaatcatatacgaaacgctcgaatgccggatccgggtttcctgcgatcattgctgctactacgtcatcatttaatccaagatttaagatggtgtccatcatacccggcatggaagctctcgcaccggaacgtaccgataccagtaacggattcttcagatcaccgaatttcttaccgttgatctcctccatcttcttaacgccttccatagcctgcgccatgatctcgtcgttgatcttacgtccatcctcgtagtactgcgtacaagcctctgttgtgattgtgaatccctgtggtacaggaagtccgatgcttgtcatctctgcaaggttggcacccttaccaccgagcagattacgcatggtcatgtcgccttcgctaaacatataaacccatttgttcgccattttgctaattcctcctaaactatacttactatgtaactatgtcagagccaacccctgccataattccgcaaacgaatgtacgtctcccaaaacgcacacatctataatatcatacttttgctaaatagcaacaattattttcgtctctttttgctgttttttgtcacaatttcacaattcaaaaccttgttccatgatgtggaacgcatagtgttttgaaaacagtaaaagagaccgggcactctgccggtctctctccccacacaaaaatgaactattcttctttcttaaattatgcgatcttctttcttcttacgatcacgcatgcacatgcacatactgcagcaagtgctgcaatgccaaacgcactgccctcacctgtcttcggggaggtcactgctgttgttccggcagaagtaccgtttccagtcttcattgcctcataatattccggtgagtaattattgttatcactggatgcaacagttgcagccggaatgcggataattgccatcggggagaaggaagtaaaggttgccgtcacaacgccatctcctgctgttgcagactctacataccagttaccgtcatgatgctgatgtaaaatgcatacattatctcctgcacttacagcaacagagaatttcagtgtaaccgggttggtctcagatgcgcctgcaacactatagtcgccagctcccagcacatctacattctgtccaaactgagctgttacagctgcctgtgccgctgctacctgggctgcggtcagctgttttacctgtacctcaattgcattgccgtttgcatctgttgccgttgcagctactgcgctgaaatttcttacataagttacgcttccatttgatgtggaagtggatgtgcttgtgctggtaccgctgcctgatgttgtaccacttgttgcattgttggttacgctcggtgcagcaaatgcagttgtgcttacagcgaatgtaagaaccattgctgctacgattgtgataattttcttcattggttttttcttcccttctttttattttgtgtggtctatatcaacgctttgcgttaatatcaagaatcttccccgatatagaacagatccaatatcatctcatagaactgttcctcatccacatgaaattcttcataataatctcccatcacctgttctcccggaaccacctgcaggctttcctctgaaaatccgcaggaaatccctgtcagcgcaagtgatagtatctgggttctggagaggttcgtcagcacagaatctgaaatgcccgcatacatccggaacggtgttctaagatcggctctcgtctcaccaatgaccttttccacaaatgctgtaagatactctttctgccgttgcagacgatactgcgcactgtacgcttcatcgcagtctctccacctcacaaaacgatacgcctgctcattattgagcgttactgtctctcccgcatggtagttctcaaaatcctgttccagaaaaaccgtcaccccgccagccattccattcagactctcaatggaattcagactaaatgtgacatatgcatcaatcgggagattataaaatagtctcgacactgcacgttccaccaattcacaactttttgtgcctccatccccaaatgcatactggagtgccagatgatcctgcagtaatccaagcggctcccccgtcatatagaacgtttccagatccgtcatcgtgtcacgcggaattgccacaatccgcaattttttctgctcccggtcgatcaccacaagaaaattggcatctgactgtgcgcctgaaccaatcacaccgccggcggacttcatatcattttctgtatccagtcccatacacagaatcgtgctgattttttcattccggcggtaagtttttccatggtacaagacggtgtcttctaacacgcatccatctgtctcatatcccgaatccgtcccacatacggcatgttttcccagactgtgcatggcagaaagccaaattcctcccgctgctgcgcatacgattatgacaagaagcagaacagccagcaggatacggcatgccaaggttcttttatgtctcactctcatagacctgtaccgcctccaccagcaaacgtttttcactttgatttttaatgcaggtcgacaacgtcagcaatttactatccgctgtcaccgcaatatcttcgcgtataacatccgtctcatcgccattttccttgagggaacttaaaaatgcctctctttcctccggttctgtaaaggatgcaaagctgcccatcaggtgtctgtcatcataagctattgcagcgaacacctgataaacccgttccctttccggtgtaatcacatagacatatggatgcttctccatatagctttcatcctgatattcatgcagtgatccaaacatagtgccgtttttcatatgatgtccatagactaccgtgttattatctgaaaaatctccggcattgcatggttcgacataaatagatcccggcagaccattctgcccttccgcagtgtgtgacagataataatcatcatagggattctctgcatcctgcttgcgcagcaccggatagctgactttcgtgtccggtatataaatccatgcacaaatatcttcatttgtctgccacagcgtatcaaaatccaccttaggaaccggtccataaatctgcgcttcgatctgctctgtaacttctgcctgaaccacaacgctctcctgactcatctgttcatactggcgctgaatcatcgcctgccggacagtgtgaaccacaaggtacaaaatgcacacaatggcaatgcctgccagtacaatctgtgcaatcctgtgtatctgttttttcttttgctgctctttttcttcgtttaacatttcaccgaactcctactgtgattctactatgattgtacccccccccccaatttttttgtcaatattattttctgccatatttcttgtcatctgcccaccatttttagacattatttcctaatttcaaaaaataccgcagacaggattcccccgccaggcgcggtcacttgcgacacgtatcctataacgaaaaaactgtcaccctaccgaacctggttcgataggatgacagttctctgtcataagaatattctttttaccacgcaaacttctgtgcaaagtaagcatccagttcctcgatcttgatgcgctcctgctccatcgtatcacggtcacgcacggtcaccgcaccgtcgttctcagactcaaaatcgtatgttacgcagaacggagtcccaatctcatcctgtcttctgtatctcttaccgatattgcctctgtcgtcgaattcacagttatatttcttggagagctgtgcgaaaatcttctctgcgccctcgtttaacttcttggaaagcggaagcactccgatcttaaccggagccagtgccggatggaaatgaagcacagttctcatatccggcttctcctcggtaccgatgttctcctcatcgtaagccgcgcataagaacgcaagcaccacgcggtctgcgccgagagacggctcgatgacgtacggcagataacgctcgttcttctcgtcgtcaaagtaggtaagatcctgaccggacgtctcctgatgtctgccaaggtcgtagtcggtacggtctgcgataccccagagttcgccccagccgaacgggaataagaactcgatatccgttgttcccttactgtaaaatgcaagttctgccggatcgtgatcgcgcagacgcatctcgtcttccttgatgccgagggagatcagccagtcacggcagaaacctctccagtactggaaccactccagatcggttcccggctcgcagaagaactccagctccatctgctcgaactcacgggtacggaacgtaaagttacccggtgtgatctcgttacggaaagactttccgacctgaccgattccaaacggaatcttcttgcgggatgttctctggacattcttgaagtttacaaaaataccctgtgctgtctccggtcttaaataaaccgtattcttcgcatcctcggtcacgccctggaatgtcttaaacatcaggttgaactgccggatgtctgtaaaattgtgcttgccgcagctcgggcacggaacctggttctcctcgatgaaattcttcatctcctcctgggtccatccgtccacggagctctgtaaggtgatgcccttctcctccgcgtagtcttcgataatcttatccgcccggaaacgctcatggcactctttgcagtccatcagcggatcagagaaaccgccgagatgtccggaagccacccatgtctgcggattcatcaggatcgcacaatccacaccgacattgtacggattctcctggataaacttctgccaccacgctctcttgacgttattcttcagctcaacgcccagattgccgtagtcccatgtatttgcaagtccgccgtaaatctccgatcccggatatacgaaacctcttgattttgccagcgccacgattttgtccattgatttttccattctaaattcctcgcctttcttaggttatattgtgatatgtttatttgtagacaatgaaagtatatacgtctgtctcgaacgaaccgtcaccggccgccgcctctgtctgctcggtatcatccgcattcaccggctccccggtcatctccatctgttcggttcccgaaagctgctcggtcccgacgctctcctgtccggtcacatccacggatgccgtcacgcttcccgtctcaagataatatccgtcacggatcgacacactgtcttttccggtcagcttcacattctgacaggagacatagcagatctcaccgtccaccttcacatccgtattggcacggatgatggcaactttcaaatcatcctcagagtaaatatcctgttttgtggcagctcccacaaccttgccttcctccacgcgggcgaactccccgtcgtagacgtatcctgccgccagggaagcaacgactttcccctgatagagttcaattccattaaatgcggtataatcctccggtgtcttgtacttcatcttaagcttcgccacaccgtcttccaccttaaggctctccaccttgactgcatttttaccatgctccgcggtgtaatcttccacctctgcatccacataggacttcagttccgtctcatcgtagtaggactgatcgagcgtctccacatccagcgacgctatcacgcctttctttcccacgtacacgacactttcctctccctccagcgaggtaccgcatccggagagaagtcccgcacacaacagtacactgcagaccgtgcacactaatctcttcatcacataatctccattctttctgaaaaagtatcggtgatattatactattttaaaaacatgatttcaaccttttccgcatcctcaagtatctttaacgacttgaaggcgtgtcccacgtacacgccaaaataactgcgcaaaagcctggtcagttcttccagtacctgcccgctcacggaaaacgtatataatttttcaatccgcgcagagatcacgtactgcatggtatagacggtggattcattcaattccaccgcatccggtgcctcgttgcggcattctgcgcagagaaccccgccgcgcttgacggaaaaccaggtcagatgctccctgctgccgcaggaaagacaggaaaacacattcggagcctcaccgtttaccgccagcgcttttagttcaaacaccgcgcgcaccagccggttgtcgtaggcactgctcgcaagggcgcgcagcgactggtacaaaagctttagcatctcgcgctcatcgttattttcctgacaataataatccgcaaattccagaaaataaaacccgtaatatgtagcatcaaaatccccggtcagctcacggaaataattctgaatcgttgccctcgcaagcgtgtaggcgcttcttccctcaaacagctcgaactctccgaagcaaaacggattggcagccgcgagaagctggctgttcggacgcctcgctccccgcgcaaatgctgtgatcttccctctttcttttgtcagcagtgtaatccgcttgtcatattcgccaatcggcattacctgtaagaccatcccggtcaccacaatattgtttcccatccggctgctcttcccccgccaaaatattactgctctcctgcacatccactgcattccggtagcgcaggtaatcagtcactcttcctgatactaaaaagtctctccaggcttcctccatcggcatatcctccgtttctttgacgcttcccgcctctaagattaggttctccgatggttccgccattataccagcaaaaaattggcagtatcagatatcgtctttattgtacccgaagttcttcatcatcagttcgctgtcgcgccagtccttgcgcaccttcacccacagttttaagttcacctgcgtatccaaaagccgctccatctcgtagcgggcattcgatccgatcttttttaacatcgaaccgccttttccgatgatgatgcccttgtgggaatcgcgctcacagacgatcgttgcatcgatgtcgatgatgttctgccctctccgctccttcatccggtcaatgtagaccgcgatgccgtgcgggatctcatcatccagagcatgaagcgccttctcacggataatctccgcgacaatggcgcgttccggctggtctgtaaccgtctcctcgtcatagaacatcggtccatacggcaggtacttgaaaatcacgtccacaaccgtatccagattctgctcccggagcgccgatgccggaacgatctctgcaaaatcaaacaccttgcggtaagcatcgatatactccaggatcttttcccgctccacggtatccaccttgttgataattaagatgaccggcgttttcgtcttctttagctgctttatgatatgctgctcgcctgccccgataaacgtggacggctccaccagccaaagaatgacatccacctccgaaagcgtgtgctccgccacattcaccatatactctccaagcttattcttcgcctgatgaatgcccggcgtatccaaaaacacaatctgtccgcgctccatatccgtatacacggtctggatgcggtttctggtcgtctgcggcttgttcgacgtgatagcaatcttctgaccgatcagatgattcatcagcgtcgattttcccacattcggtcttcctataatcgtcacaaatccggatttaaaattatctttcatcgttctcctcgtttctgtactgttttcccctccccgcatcaggtcaggctctcaagtgtctcaaacatctgtttttccgatgtcagcacatcttcattgccgatcacacacaggctgccgtctgagagcaccgacgcaatcaaaggcttcaatgcgcggatgtccgccggctgtgccccgataatctggctccgctcctttgaaagcgtctcgtagtccagctcctgcagataggctgtcatcgaacgcgcacccttcgcgctcgggttcatcggcgtgtccatatcgctgatcgttccgatgatatatcctgtcatctcgcgctcatcggcatcaaacttctcaaggtacgccgggatgccgtcataaatctcattcgttgcagagagattcggatcccggtaggacacaaaatacgtatctccgttcctcatatatccgttcatgcagccataagcgccgcccttgacgcggacattgatccacaggtaatcgtatcctaaaattacttttaagatgcggagcgccccgtgataggaaaagccgtgtgcggcataatttccagcacgcgccacatactgcacctgggatgcgtccataaatccctcgttcttttttgccagcggataggacggcatagagcgattcttacccggctgatccggcacatacaatacatttttcaatgcagccgacgcctgcgtcaccgccgggatctccgactcctcgcaggttgcactcaccagcatacgctccgctgtaaaaatggttttcacaagggaggacagcttctccatcagctgctgctttttctcctcaaaatgctcctcgtagtccgcgatcacgcgatagcaggcaatgcccgccgtcgcatcctggcagtaggcagccgtcgaaaaatacgacagcgctctcgtatatgccacggaatgtccggaagcgctcagtcccgcctgcagtctcgacttcaactgtgccaggatctcgtagatacgcttctcgtccgtaagatgcgaggtcagaagaatctccttcatcaggcgcattgcatccggcaatcttgacgcgagcaccttcgtgcgcacctcatagtaaagtccgatttcgccctgctttttgacgttcgggtagatgccgatgctgctgccgattcctccggtgtacatattgatctcattggcaagcgccgcgtaggaatgattgtccgtatccacatatcccagcactgcctttaagataccgagataaggcagatcttccggcagaatatcgcacacatcaaacagataggtcaggtaatcgataccattcgtgtccatctcatgcgcaacgatggaaacgccctccgtctcaatctcacggttaagaagcggcgccgcctcttttttcagatccgctctcgtaaggcgtggaatcttctctaagtcttccttcggcgacggctcttcctgatactgctttaagtgcttcgtgtctgcgatcagcttctttcgctcttccctggacaatcccgctttgtattcggccagcttcttctccagcgcggcatctctctttgcgcccagcccctgctccggcaccgtaatcactactgacgcatgcggattgtccagaagatatgtctttaccagttcctcataatatccggttccgatctgatccttcaaaaactgataggtgtccagcgcttccagatgcataaacggctgcatatcatcgaacagccagctgtccagacactggattccgtagagcagtcccttcggaaactgtccgaaatccgcctcccggaaacggaattccgagctgttgattccggctaacaatgcgttttgatcaattccgtctgccacctttgcctgcagcgtctcacggatcacctgcaaaaactgctccttctgctccggattcgcattttttgctatcacggaaaataccggctgcagcgtgctgttatcatagccgccgccgatgtccataccgattcccgcatcgatcagcgcctgcttaagcggcgctcccggcgcagaaagcagtgcgtagtccaaaacgtcaaacgcctggtataactttttgtccagaacggttccgaccaccacattgtaagacaggtagctgttgtccgtaagcggctcccccgatgccaccggataaggctttacgatctccaccggcgcggcgaacggcttctgcatccggattgcggaatccagctcgatctgctcgtattttccgaggtattcctcatccatccagcgcagcttttctgcaacgtccatatccccgtacagatagatataggaattgcacggatgataatactttctgtggaagttcagatactgctcataggtaagctccggaatatgctccgggtcgccgccggattcgtttgcgtaagaggtatccgggaacagtgaatttaaaatcaggcgctccaacacatcatccggggacgagaaagcgcccttcatctcgttgtacaccacaccgttgatcgttaccggcgcatcttcatcctccagctcgtaatgccagccttcctgctcaaagatctctctgtgcttgtagatgttcggatgaaataccgcatccatatagacactcatcaggttctgaaaatccgcattgttgcagctcgccaccggatagatggtcttctccgggtacgtgatcgcatttaaaaatgtgttgagcgatcccttgaccagttccacgaacggatccttgaccggatatttgtccgatccgcagagcactgtgtgctcaatgatgtgcggcacaccggtcgaatcctccggcggtgtgcggaagccgatgtaaaacaccttgttctcatcgtcgttggagatcacggtgattctcgccccgctctttttatggcgcagaatatatcccatcgaatgaatatcctttaactcctgctcaccaagcagctcatatgctgtcaattctgaaagcttcataaatccataattcctttcctgcccggtcatcctgtatgtccggtatttacactgtgttctattataacagcttttcccattctgcaaaagagtaaactatctatagattttgtctggaacactctgcgaacggtgccggcaaagtaccacatgaaagtttctgaaattgtccctgatttgctgggcacctgccagattgtccaaacgcaaaaaagaggctgcctgaatgcggcagcctcctcccatgtcttcacagatatattctactgataagaactccctatgcgatgcgtgtcacattcgctgcctgcggtccctttgcaccctcagtcacctcgaactcgaccttctcgccgtcctttaactccttgaatccatccatattcagtgcggaaaaatgtacgaatacatcgttgccctctgcatctgaaatgaagccatagcccttcttggcattaaaccactttacagtaccctgctgcataattctaaaaaccctcctcaatacagttctgacattacagactattcctgtctgtataaaacaacaaattgaaattagcacattttactttttttgtcaatctttttctatcgttattgtttaatttgcacatcaatctgctggtatgggatagaaattcccttcgcatccagcgcatacttgatattttccgtcatgcgccagcgcgccggccagtaatcctcggtcttaacccagaccctgagtccgatgtccaccgaagatgccgccaggttgtccacatataccacaggcttctcctccgggattctggcttcctccttctccgccaccgcatagatcacatctttggcagtgcggatatccgcttcataggcgatgcccaccacgagatccacacgacgtctgtccttgttggtcacgttggtaagactgctgttggaaagtgtaccgttcggtatcacaatcagcttgttgtccacggtaagaagtttggtataaaaaatggaaatctccgtgaccgtcccctcattattgtgggaatgttcaatgatgtaatccccgaccttgaacggctttaacagcaaaatcagcacgccgcccgcaaaattcgacaggcttccctgcaacgccagaccgaccgccacacccgccgatccaagcaccgccaccgctgatgtcgtcgcaattccaaacaatcccataatgataaaaatcagcactacatacagcgaatacttgatcaccggtatcatgaactgcttgacgccctcatcggttcccgcccggtccatcgagcgccgcaccagctttgtgatccacttgatgatcctgcctccgatcacatacacaagcagtgcgatcagaatctggaatgcgaagtttaacagatccggcaccagcccttccagccatgtacggataatccccggattctttgctacctcctcaattccctcctgtgcatggttcaatgcctccacggtctccgtggtcgacgggaatgcatctgtctgtgccgccagataccttccctgttccaaaagtgccgctatcccgttcactctctcgtcctccatccaactttataatccttcttaaatttcatgaataaacagaccgctccttagcttcggctcgaaccaggtcgatttcggcggcatcaaaagtcccgcatccgccactgcgaacagctccgcaatggacgtcggatacattgcaaacgccaccgcgcagtcctgctcacagcgccgcaccagttcgtccatgccccggattccaccgacgaaatcaatgcgtccgtccgtcttcggatctctgatgccgagcaccggttcaagaagcttattctgcagtatggaaacatccagatctgcaaccggatcttccggcgtgcggtcctcctgccggatatggcaggaaaaccagtgtccttccatatacatgcaaaaggttccccgctccttaggtctggtatcctctgccccggtaatctcctcaacgtcaaaccgcttctcaacttcacggtacaatcccttaaaagaatacccgttcagatcgcggatcacacggttgtaatccataatcatgagttcatcatccggaaacaataccgagagaaaatagttaaactcctcctccccggtataacccggatgttccttccggcgcttctgccctacttttaccgcggacgctgcccggtggtgtccgtctgcaatgtagatgctgtcaacgcccgcaaacgcttcgtgaattgcggcaatatccgcatcctcgcggatgacaaacacccggtgtctcacgccgtcctccgatgtgaaatcatattccggctctccctgcttcgtcttttccacgatacgccggatcccgtcattcgcgcggtacgccagaaagatcggtccggtctgtgcgttacagacatccacatggcggatgcggtcgacctccttctccgcgcgggtattctcgtgctttttgatgatgccgttctcataatcatcgatggacgcgcaggctgccactcccgtctgcactcttccgttcatggtgagttcgtagaggtaataacactttttatcctccgtcagaaacgtgccgtcctccacccattgccagagcgtgtcatgtgcacgctcatacaccttgtcatcatacatatccactgacagcgggaactgtgtctccgcgcggtcgatgctaaggaaagactgcggatgccgctccacttccttcgtagcttcctctctgttataaacatcataagggagggcagcaatctctgctgccttccctctctgtggtctgatgcttacaaatggtctgatttctgccattgttctcacacctcgttattttactttccgtacttttagtactccatccgtctgctccagctttgcgagcacatcctccggcacgttcgtatccacatcgatcagcgcatatgcatagtcgcccctggacttgttcgccatgccatcgatattgattccggcattgccgagaattgtcgtaaaatggcttaacataccactctcgttcttgtgcagaataccgattcttcctgccgtcatgcaagcgcccatgctgcagtccgggaaattgacggaatgtacgatattgccgttctcaaggtaatcgcggatctcgcgcactgccatgagcgcacagttgtcctcagactctgccgtggatgcacccagatgtggtgtcacgatgcagccctttgcgccgactgtcgtggtgttcgggaaatcggagacatattttttgatcttgcccgctgcaagtgcgtccaccatcgcctcctcatccacgagaagatctctcgcaaagttgagcacgatcgccgtcggcttcatcattgcaatcgcatccgcgccaatcatctttctggtggaatccaaaagcggcacatgaatcgtgatatagtcgcactcgcggtaaatgtcctccacgttgctgatgtgcttcacgctccgggaaaggctccacgctgcactgacggaaatatacggatcgtagccgtacacttccattcccatgtgggtcgccgcattggcaaccagaacaccgattgcaccaagtccgataacacctaacttcttgccggaaatctcggttcctgcaaaatttttcttctgcttttcagcagttttggcgatattctcgtcgttctgattcgccagacaccagtcgatgccgcccacgatatcacgggacgcgtagagcattcccgcaaacaccagctccttgacaccgtttgcattggcgcccggggtgttgaatacgacaattcccttctccgcgcatttatccagaggaatgttgttcacgccggcaccggctctcgccactgccgcaagtccctccgggagttccaggtcatgcattgcggcgcttctcacaagcactgcctccgcatcctttatgtcttccaccttctgataatcatccgaaaacagatccagaccgaccgctgcgatcggatttaagcaatgatacttatgcatttgcattctcctcctcgaactttttcataaacgcaaccagcttctccacgccctctttcggcattgcattgtagatggaagcgcgcataccgcccacggtgcggtggccttttaaattcacaaagcctgcggctgtcgcttcttttacaaacttcgcatccagctcttcgttgccggtcacaaacggcacattcatgagggagcggtcctccggaacaacggttccgtggaacagtttgctctgatccagaaaatcataaaggatcttcgccttttcctcattgcgctccttcatcacggaaagaccgcccatcttctttaaccacttgaataccttgccgcagatatagatgccgtagcacggcggtgtgttgtataaagaatccgcatcggcgtgtgtcttgtattttaacatggttggtgttcccggaagggtatcttccgtgatcagatcctcgcggatgatgacaatgacaacccccgccggtcctacgttcttctgcacgccgccgtagatcacaccgtattttgtcacatccaccggctcggacaaaaagcaggaggatacgtccgctaccagcgtgtgtcccttggtattcggaagcttcttgtattttgttccgtagatcgtattattctcgcagatgtacacataatccagatcttccgggatatccaggtcagaacaatccggaatataagaaaacgtcttatcctcggaggatgcaagctttactgcctcgccgtaaatctgtgcttcctgataagctttcttcgcccactggcctgtgacgatatagcctgccttgcggttcttcatcaggttcatcgggatcatggcgaactgctgggatgccccaccctgtaaaaacaggactttgtaattgtccggaatgttcatcagatctctcagatcctgctctgcctctttgatgatgttgtcatacaccttggagcggtggctcatctccatcacagacattccgcttcctctgtaatccagcatctcatctgctgcttcttttaagacctcttccggcagcactgccggacctgctgaaaaattgtacactctgctcattttctaattcctttcctttctcttttattacggcagttccctacgctgccgcctccatgccccctgtaacaaaacatatacgcatgttatgactgcgctgcggctaaatcctccccggtaaatgccgtactgatgtccgcacccggagcaaccatcggccataccttgtcatcgcagccgatcacacaatcgatcactaccggcgtctttgcagcaagcgctgcttttaacgcctcattaaatgtctcgcgggttgtggcgcggtaccctgtcgcccccatcgcctccgcaagcttcacatagtcgacgccgtcatctaaaaccgtcgctgaatagcgtttttcgtaaaacagatcctgccactgccgcaccatgccgagcacatgattgttcacaatcacttcgatcaacggcagcttctgccggactgcggtagcaatctcgttcatattcatgcggaaacatccgtcccccgcgatattgatcacctgttttcccggatttgcaacctgtgcaccgatcgcagcgcccagtccgtatcccatggtgccaagtccgccagatgataaaaacgtgcgcggatttttatatttataatactgtgcagcccacatctggtgctgtcctacttctgtcacaatgatggcgtcgccgtctgtctggcggtagatctcctccaccagataaggtccggtcagtcccggctcctggtatgtgagcggatattttactttatagtccagaatatgcgctatccacgcttcatgccccagctgcggcagttccgcgttgatccgctttaaaatttctttcaggtctccgatcacagccgcatcgacacggatatttttattgatctccgctgcatccacatcaaactgtaagatcttcgcctgctttgcaaacttcttggcattgccaagcacacggtcggaaaagcgcacgccgacggcgatcagcagatcgcactcgctcacgccgaggttggacgtcttggttccgtgcatgccgagcatccccgtgtagagatcgttcgtcccgtcaaaggctccctttcccatcagggaatcgcacaccggtgcgtccactttatgtacaaattcttttaattccgcgctcgccccagagatcacagcaccaccgcccacaaatatgtacggtttttccgccgcttttatcatcgcaagcgccttcgcaagatcctcttctcgtatcgtgtccgtcacacgcgcgatcggctctgccttgcagaattcatactccgtctttgccgccgtaatatccttcgggatatcgacgagcaccgggcccggacgccccttctgtgcgatccggaatgctctgcggatcgtgtccgcaagctttgtgacatcctttacgataaaattgtgctttgtgatcggcgtcgtgatgcctgcaatatcgatctcctgaaaactgtctttgccgagaagcggcacattgacgttgcatgtgatcgctacaatcggcacggaatccatgtatgccgtggcaattcccgtcacaagattcgtcgctcccggtccggacgttgcgaaacagacacctacttttccggtgcttctcgcataaccgtccgccgcgtgggaagctccctgctcatgcgaggttaaaatatgccgaatctcctgatgcttatataattcatcgtatacattcagtatggctccacccggatatccgaatacggtgtccacaccctgttctttcagacattcgatgacaatctgtgctcctgtcagctccatgtcgtataccttccttttctatcctactgttcttccgggagcgccagtattgctccgcggttgcccgaggtcacgagcgatgcgtaccgctttaagtatccggtcgtcaccttcggctctctcggctgccatttcgcctttctggcggaaagttcctcgtccggtacggcgagttccagctttaactccggaatattgatcctgataagatctccctcttccaccagtgcaatcggtcccccgaccgctgcttccggcgatacatggccgatcgacgcgccgcggcttgcaccggaaaaacgtccgtctgtaatcagcgccaccgaagatccaagacccattcccgcgatcgcggaagtcgggtttaacatctcgcgcattcccggtccgcccttcggtccttcatagcggattacaacgacatcgccggcaacaatcttaccgcccttgatcgctgcgatcgcatcctcctcacagtcgaagactctcgccggtccctcgtgcaccatcatctcatcgcagaccgccgagcgcttgaccacgctaccatccggcgcaagattgccttttaatacggcaagtccgccggtcttgctgtacgggtgatccaccggacggatcacttccggattcttattcactgcatccgcaatattctccccgacggtctttccggtcacggtcatgcactccgtgtgcagcagtccgatgtccgccagttctttcattaccgcatagacgccgcccgcctcgttgagatcttccatataagtcggtcctgccggtgccaggtggcacaggttcggtgtcttctcgctgatcggattggcaaatgcaatatcaaaatcaaatcccacctcatgggcgattgccggaagatggagcatgctgttcgtcgaacagccgagcgccatatccacggtcagcgcatttaagatggcttccttcgtcataatatcacgcgggcggatatttttgcggtacatttccatcaccgccatacccgcatgcttggcgagcttgatgcgctccgaatagactgccgggatcgtgccgtttccgcgaagtcccattcccagcgcctcggtgagacagttcatggagttcgccgtgtacattccggaacaggagccgcaggtcggacaaaccttctcctcgtattccttgacttcctcctccgtcatcgtgccggccgcataggaacctaccgcctcaaacatggaagagagactgcgctttttgccctgtacatgtccggcaagcatcggtccgcctgacgcgaacactgtgggtacattgatgcgcgctgccgccatcaaaagtcccgggacattcttatcgcagttcggaaccatgacaagcgcgtcaaactgatgtgcaagcgccatacattccgtggaatcggcaatcagatcacgcgttaccagcgaatacttcatgccgatgtgtcccatcgcaattccgtcgcagaccgcgatcgccgggaataccaccggcacgccgcctgcctccgcaacgccaagctttaccgcgttgacaatcttatccagattcatatgaccgggaacaatctcgttgtaggagctcacaatgccgaccatcggcttgttcatctcctcctcggtaaatcccaacgcgttaaacaaacttctgtgaggtgcctgctgcatccccttttttacattatcactcttcatctatcttaactccgtttctgtcattctatctgatccgctcgcagatcagatctcccatctgtgccgtgccgacctgggttaccttttcctgcggcttctcctgcggcatgatgtcaatggtacggtagccatcttgtaagacctgcttcaccgcctgttccactacatccgcctcccgatccagatcaaaactgtaccgcagcatcatggctgcacttaagatcgtcgcgatcggattggcgattccttttccggcaatatccggcgccgaaccgccgctcggctcgtagagtccgaactttgtatcgtttaaactggcgctcgagagcataccaatcgaaccggttaccatgctcgcctcatccgacaaaatatcgccgaacatgttctccgtcagaatcacgtcgaactgcttcgggtcttttaccagctgcatcgcacagttgtccacgagcatatgctcataggtcacttccgggtaatcctgcgccacctcctcgacgatctttctccagagtctcgaggaatccagcacgtttgccttatctacactcgtcacctttttgcgccgcttcatggcaatgtcaaaaccgcgcttagcgatccgtctgatctcgttctcattgtaggtcagcgtatccgtcgctgtcagcacaccgtccacttcctcggtcttgcgcgctccgaaatacagtccgccggtcagctcccgcataatcatcatgtcaaatccgtccccgatgatgtcgtcccgaagcgggcatgcggcttttaattcttcatataaatatgccggtcttaagttagcaaacaggttcagcgccttgcggagttttaaaagtcccgcctccggtctcttctccggcggcagctgataccacggcgaagtcgatgtgttgccgccgatcgatcccatcagcaccgcatcggaagccttcgcggaagcgatcgccgcatccgtgagcggctcacccgtcgcgtcaatggagcagcctcccatcagaatctcttcatagcggaacacatgtccgtaggtctttccaatctgatccagaactttctttgcctctgttacgatctccggtccgatcccgtcgccggaaatcacgcctaccttatattccatctctctaatccctcttttcttcctgccatgcaggaatccgtcttgtattgactttagtacattactaacagacagtatataaattctataataatgtatctcgggaaacaatgcaacctctgaatctatttttctttttcatgtattccataacctggtcttatttactgcttttttaacgcaacacttttcagttcaaaataggcgagcagattctggttgcgccagtcctctgcatcctctgtaatatcatccatacaaatcatatagggctgctctgtataagcatccacgagtgcatccgttcccttcgccgcctctaatgtatcgtgtctttcatacgcttcctgcgagtatctctgcgcagttcctgttttgatctgcaaatgtgcctgataagcagtcgagctctccccgcagccgatgagcaccccaagcagcagcacccccgtcacagccagatggccatgggagagctggtttatgacattctccgaagcagtgtccccagcaaggacacgcaccagccatccgcacaaatagaactctacgacaaacagtagcagcacatacgtaaaatacaccacatttgccagtcttccatcacctgctgctcccattccataatatggcggacaatacaatgcacagatataccccaccgccagaactaccaccaccagcggatatgaaaaacggaatcccttctctcggtacagccgctgcgccgcacgcaggataaacggaaggaacgctaccatgccgatgagtattttcagccccatccactggttgatcgcactaattccccatttcgttgcaagccagatggtttcaaaaaagcccggggtattttcaaatgccgactggcgtaccctcgtgccgggagagagcacattgatcagaaaacctccaactgtcactaccagtaccaccaaactgtctaccaaaaacggctttcgatgtaccactcctccataaatcacacagcctaccagaaaaaggattccgccaaacgccgtcacgtgattaccgcccgccagaagcagtccaagcagtcccgtgagaatcatctgcaggatgcgtctctttccctttcctcccaaccacaatgccgccgaaacaagcagcaataatacgcagaagaaaaacgtgtaattgaccgcaccattgtaccagtagattccctgcactgccgatggaatccactgcagcatcagagccgacatcataaaaccaaaggctgctgcttccagcctgcccattccaagctttctgtgcagcacctgccatgcaaaaatcagattcgcgccatacagagccgccagaatcagacacgcagcgatccgataccacgcttcgccaaaaataccgggctccagtgcctatatcaccgcggaggcgtaaagtccctgccaggtctggtaaaactcggctgaagttgcaaatgccgccctgcacacctcccacagggaatgtgtatctctccacgcatgataggtttctgatgcataccagtaatcgtctccagacggatggttgtacatggacaggtgcaaaagcggcaccaccgataaaaccgatattacaataatgctccaaagaatcattttttcatgctgctttttcatatatctttctccatttccatcgccgtatatttttttctcatcactttcataataattcccctatgatccaaaaaatctgccctgtattgctacaaggcagattctcttagatttccattcaatatcctgcttattcagctgcttcttccggcttctcaactgcggagatggccgccttctgcatcggaatacggcagttcttgttgcttccgaactcaacgattactgtatcatcagcaatatcgatcactgttccataaaaaccgcttgttgttaagatcgtatctcccactgcaagttctgcaagcatggagttcttcttctgctgttccttcttctgcggacgaaccatgaagaaatacataaacgcaaataaaataaccagccacaccaccatactgatccagccagcggatgacgcactctctgttgctaagattgaaaacatctgatatcctcctaaaatcataaacttgtccgaagtcatccgacttcattaaagagtattgtacacaaaacctcgctgtttggcaagccttttccctcttacttttccatttccttttcccggttgatctgtcccatgctgtatagcttttcttccttgtaggaggcaaagtttccggcatccagcgcatcccgaatctcttccatcatcgtgttgtagaagtacagattgtgcagaacacataagcgcatgccaagcatctcttttgccttgagcagatggcggatataggctctgctgtagcggcggcaggtcgggcagccgcagccctcttcgatcgggcgcatatccttctcgtacttctggttgaacaggttgatcttgccctggttcgtgtatacatggccatgtcggccgttgcgggacggataaacacagtcgaagaagtcaatgccgcgctccactccctccagaatattggccggcgttccgactcccatgagatagatcggcttgttcaccggaagataaggcacggtctcatccagcacatggtacatctcctcgtgtgtctcgccgaccgcaagtccgccgaccgcatagccgtccagatccagctcggaaatccgctttgcatggtcgatccggatgtccgtgtagatggctccctggttgatgccgaacagcatctggtgacggttcacggtatcctccagcccattgaggcgctgcatctcgttcttgcagcgctccagccaacgtgtcgtccgtgccacggaatcctccacatatttccgctcggcaagcgccggcgggcattcatcgaacgccatagcgatcgtggaaccgagattggactggatctgcatgctctcctccggtcccatgaaaatctttgccccgtcaatatgcgagtggaaatagacgccctcctccttgatcttgcgcaggcctgccagggagaacacctgaaatccgccggaatccgtaagaatcggacgattccacgacataaacttgtgcagtcctcccacttccctgatcagtttatcccctgtgcgcacatgcagatggtaggtgtttgacaactccacctgacacttgatctgttccagatcttccgtggagacagctcccttgatggcagccaccgtacccacattcataaataccggcgtctggatatctccgtgcaccgtatggaaaacgcctctcttcgcgcgtccttcctgttttaataattcatacatctgtttttcgtctcctttttattactcatgcaaagccggcgctgcttcacgcctccgtcttcttcccggtcagttcgcttaacacggtaaagtaatcttcaaatgtcttgcggcagcacgctgggttctcaatcacaatcccgtcagttctaagcccgatcagggaaaatgccatcgccacacggtgatcgtcgtatgtctccacgtttccgccgtgggggctgccgggatagatcgtgacagccgtctcttcctcctcacaccggatgccaagcgcggtcagattcgtctgtatcgcgtgaatccggtcgcattcctgtccgcggatatgtccgattccctctatgcgcaccggcgcgtcggcaaacggcgcgatcgccgccagagtcagtgcctgatcggagaaatcgttcatattgactgtgatgccccgcagcgcaccgtccgccggtcccgttacccggacgccctccggcgtatcatccgcattacatcccatgcgctccaacacttccagaaaacgcagatctccctgtgtgttgtccatatgcacatgacgcacaagcgcccgtccgccggtcaccgccgcagccgcgtaaaaatagcaggctgccgacatatccggttccaccgtataagtctccttccggtaggaagcctccgcgggcacctcgtagtctcttccgtcaaaagtgacactcactccgaatttctgcatcattttccgtgtgatacggatgtacgatccgtccgtcttctcgctggtgatgtggatcttcatcccctccggaaccatcggcgcaatcagcagcagcgcgcttaaaaactgcgtgctcttcgtaatgtcaagggagagcctccgcggcgtctcccctgccgtctcatctgcccgggcagatctgcaccctgcgatgcgcaccggaagatgcccttcctcctcgaggaaggtaatcttcgcccccgcaccggaaagcagctcgaacagctccgccatcggccgccgcttcatctgcgctgaacagcggatctcataacacccgtctgaaaatccgagcatcgccgcaaggaaacgcgccgctgtcccggcgcttccgacgtcaattaccgcttccctgctgggaatcctgccgccgcagcccgtcacggtcacgcactttttttcttcctctatctgcactgcaaagccgagcgacacaagacacgccagaaagtgtctggaatcatcggaaaacaggacgccttccacgcgcaccgttccggcggacagcgctgctaaaagaagcgcgcggttcgtcatgctctttgatcccggcacggttaccttccagtccaccggctctgttatctttttcacaaggtatttctctatcatgaaatattcttctcctcgcctgctggtacttctgctccgtcaaatcataacatatttctgttgcggcgcaaagtcaaatcttttataatcgagaaagatcattatgtaagcaggagggaatcacatggcagggtctacattgggaactctttttaaaatcacaacctggggggaatctcacggaaagggtgtcggcgtcgtcatcgacgggtgtccggcgggactttctctctgtgaagcggatatccagaagtttctcgaccggcgcaagcccggtcagtccagatatgcaacgccgcgcaaagaggacgacgccgtagagattctctctggcgtgtttgaaggaaagacgaccggcaccccgatctcgcttgtcgtcttcaaccgcaaccagcagtccaaagactacagcgagattgcctcctattaccgtcccggtcacgccgattacacgttcgaccagaaatacggcttccgcgactaccgcgggggcgggcgctcctccgggcgggaaaccatcgggcgtgtcgccgccggcgccgtcgccgtcaagattctaaacgagctcgacattacctttataacctacacaaaatccatcggcccgatcgccgtatcttccgggcactttgatttttccgaggtcacaaagaatccactctatatgccggacgccgaagcggccgagaacgctgaaaattatctggatgcctgcatgacggagttaaattcctccggcggcatcgtggagtgtatcataaaaggaatgcctgccggtatcggagatccggtctttgagaagctgaatgcaaaccttgccaaggcggtcatgtccatcggcgccgtcaaaggttttgagatcggggacggatttgacgtggcaaaagcgaccggcaagaacaacaacgacgcctttgtcctcggtgaggacggcagaattgccaaagcaaccaaccatgccggcggtatcttaggcggcatgagcgacggaagcgacatcatcctccgggctgccatcaagccgaccccttccatcgccgccacacagcgcaccgtcaatcagtccggtgaggagatctcggtcaacatcaagggacgccacgatccgatcatcgttccgcgcgccgttgtcgtggtggaatccatggcggccatcacgatcgtcgactcactcttttccaatatgagcgcacggatggatgcgttaaaagatttctactcctaaaagaaacaaaaaggtgatacttcttctccgccggctggcgcaatcgaagtatcacctttttctttttcatactttctagctcatccgaatatgctgatgtgtaaacagatgatcctgacagtattcgtaattgccctcgcacttggagcagaaacggaattccagcgtcggatcgtcaagttccgtcctgccgcagacagcacacttgtgcttcgcaccgcccgcatatccctgcggtcttcgcatgtctgccttaaacttctggcgtctgtgcacctcgtgcggcgtatagcgcttgaggtttctggtggagaagaagaaaataataaagttgaggagcgacataaaaatcgccattcttcccgcccatccggtctcaaaaaagcttaaagcaatcagaacgccgtacacagccgccatccacttcatcttaatcgggataatgaacatcagaagaacctgcatatccggatacatacatgcaaacgcaaggaagatggacatgttgatgtaacttgtgctgaaactcgttccgatgagaagcatctccgtcgtcacaccgccgttcaaaagatacatgataccgtacagcaaaaacgctccgatgacggtaaacagcatacctccgaaaatatagacgttaaaccggaaggttccccatgtgcgctccagtgtcgttccaagctgataatagaaaagcgccataatgagaagatacaccagattcgtgtctgtgggcataaacacccaggtaatcagacgccagatctgtccgtgcaggatgtgatacggactcaacatcaaaagtcctatgatcgacggattcacctggtagagcacaaacccgatcgtgtaagctccgatcagccacacgatcagattgggaatcgcccaattgccgaatttacgttctaatttatttaaccagttcatatactctgttcctgacctttccaaaaatgacattacgttgttcagtatatcggtcggggaaatctttgtcaatcagagggattcttctttacaaaaagtttatacttttccggcaaaatgcacattgtcttttgacatatcctgtcgtataatgtagagtgtttatcgccagattggcactatttataataagaagaaatcttttacatattttactctgctaaagtatttactttacgagaaacagccatggagggaattatggaaaacaatacacttcataaattgggaatcgacatcggttccacaaccgtcaaggtcgcaattttagaccaggaggatcatctgctcttctctgattatgagcgccattttgccaatatccaggagaccttatcctcccttctccagaaagcttacgatgcactcggcgactttgctgttgcaccgatgattaccggttccggcggtctgacactcgccaagcatctcggtgttccgtttgtccaggaagtgatcgccgtgtccactgccctgcagcattatgcaccgcagaccgatgttgccatcgagctcggtggtgaggatgccaagatcatctattttgagggcggcaatgtcgagcagcgtatgaacggcatctgtgccggcggtaccggttcttttatcgaccagatggcatccctcatccagacggatgcgacaggtctgaatgaatacgccaagaattacaaggccatctacccgatcgctgcgcgttgcggtgtctttgccaagaccgatatccagccgttaatcaacgagggtgctaccagagaggatctctctgcctccattttccaagcggtggtcaatcagacaatcagcgggcttgcctgcggtaagccgatccgcggccacgttgcctttctcggaggtccgcttcatttcctctccgagctcaaggctgcttttatccgcaccctgaatctggacgatgaacacgccatcacaccggagaattcgcatctgttcgcggcgatcggttccgcgttgaactacaagccgggcgagacaaccacgctcgtctctctccgcgaccggctctcgaacggcatcaagatggaatttgaggttgcccgtatggatcctctgtttgccagccaggaagaatacgacgctttccgcgcacgtcacgacgggcacaatgtcaagtccgcagatctctccacctacgagggcaactgctatctgggcatcgatgcaggttccaccacgaccaagattgccttagtcggcgaggacggttcccttttgtattctttctacagcaacaacaacggaagtccgcttgcgacggcaatccgttccatcaaggagatctatacgctccttccaccgaaggcaaagatcgttcactcctgctccaccggatacggtgaagcgctgttaaaagccgctttgatgctcgatgacggcgaggttgagacggtggcacatttctatgcagccgcgttcttcgacccggaagtcgactgtatcttagacatcggcggtcaggatatgaaatgtatcaagatcaagaatcagacggtggattccgtacagctcaatgaggcttgttcctccggctgcggttctttcatcgagacgtttgcaaaatccctcaactactctgtacaggattttgcaaaggaggctctttttgccaaaaatccgatcgatcttggaacccgctgcaccgtatttatgaattccaaagtaaagcaggcgcagaaagagggcgcatccgttgcagatatttctgcgggtcttgcgtactctgtcatcaagaatgctttatttaaggtaatcaagctttccgatgcaagccagctcgggaaaaatatcgtcgtacagggcggtacgttttacaacgatgccgtactgcgcagttttgagaaaattgcgggtgtcgaatgtgtccgtccggatattgccggcatcatgggtgctttcggtgccgcactgatcgccagagagcgtcacgaggcaggctaccagacctccatgctttccatcgaacagatcaatgcgctgaccttcgacacaaagctggcaagatgtcagggatgtaccaaccactgtctcctcacaatcaaccgcttttccggcaaccgccagtatatcaccggcaaccgctgtgagcgcggcctcggcaaggagaaaaataaagacaacattccaaacctctacgaatacaagaacaaacgcctgtttgactacaccccgctttccgccgaggaagcagcacgcggcacagtcggtattccgcgcgttttaaatatgtacgagaactacccgttctgggcaactttctttaagaagctcggtttttccgtggtactctccccgcagtcgacgcgcaagatctacgagcttggaattgattccatcccgagcgagtccgagtgctacccggcaaagctggcacacggtcatgtgacatggctgatccaccagaacgtcgattttattttctacccgtgtattccttatgagcgcaacgaattcccggattccaacaatcactacaactgtccgatcgttacctcctacgcggaaaatatcaaaaataacgtggacgagatcacttccggtcaggtgaagttcttaaatccgtttatgtctttcgccagcgaggagacgctttcctcccagctgattaagacctttggccagtcggagttcgggattccggaatccgagatccgcgacgcggttgccgaaggctggaaggagcttgccgtctgccggatggagatgcagaaaaaaggcgaggaagtcttacagtatttaaaggagaccggaagacgcggtatcgtcctcgcaggtcgtccgtaccatgtagaccctgagatcaaccacggtattccggagctaattacctcctacggcatcgccgtgctcacggaggattccatctcccacttacagccggtggagcgcccgctcatcgtcatggatcagtggatgtatcactccagactgtacgcagcggcgaactatgtcaagacaagagacgatctcgacctcatccagctgaattccttcggctgtggtctggatgctgtcacgacagacgctgtcaatgatattctgacaaagtccggcaagatctacacctgtttaaaaatcgatgaggtcaacaacctcggtgcggcgcgcatccgtatccgttccctgatctcggcgatccgtgtccgtgagaagaagcagacgaagcgcaccatcgttccggcgaattacaaccgcgtcgtcttcacggaggaaatgcgcaagaattacaccatcctctgcccacagatgtcaccgatccattttgagctgttggagccggcgttccagacggccgggtacaaccttgttgttccggatgtggacagccgcacctgcgtggatgtcggcttaaagtacgtcaacaatgacgcctgctacccgtccctgatcgtggttggccagctgatggcggccgtgatgtccggcggttatgatatgtcgcgcaccgcggtcttaatctcccagaccggcggcggctgccgcgccagcaattacatcggcttcatccggcgtgcactggaaaaagccggctatccggacgttccggtcatctcgatcaatctgagcggtctggagaagaacccgggctttaagctgacactgccactgatccagcacggactctacgcgttggagtttggcgatatcttcatgcgctgcgtctacgcaacgcgcccttacgaggcggttgccggatcaacggacgagttgcacgaaaaatggaaaaaagaggttatcgcctttattacccagaaaaagatgctctcccacggcaagttcaagaaaatgtgccgcgagatcatccgcgattttgacaaccttccgcgcaaagacatcaagaaaccgcgcgttggcgttgtcggcgagattcttgtcaagttccatccggctgcaaacaatcatctggtggagcttctcgaatccgagggcgcagaggcagtcgtaccggatctgaccgatttcctgctctactgcttctacaatacgggctttaaagcagacaatctcggcatgagccagaagtccaagaagatcggccgtctgggcatcaatttctttgagtggctgcgcagcgctgcaagagatgaattcacaaagagcaggcactttactgcacctgcgcacatcgatgatcttgccagatatgcaagagacattgtatccgagggcaaccagaccggcgagggctggttcttaaccggtgagatgttagagctgatccacaccggaacaccgaacatcgtctgcacgcagccgttcgcctgcctgccgaaccatgtggtcggcaagggtgtcatcaaggaactgcgtcaccgctatccgggttccaatatcgtggccatcgattacgatccgggtgccagcgaggtaaaccagctcaaccgtatcaagctgatgctctccaccgcgaacaaaaatctggcaaagcagaacgcaccggagcagaaggatcaggctgcaggctgacagatacagagaaaggggctgcgcatcaaatgtgcagccccttttcgtgataagtaatattatcagaagatcacaccgtgggatttcagatggagatacagagggaaatttggttcaaaaaatgtggcatttctaaccagccggatgtttgcatcttcgatgatccgtgtctttccaagtttggagcactccgcgggtcatgtccgcatcccggaagacaatttgtaggacttttgtgtgtgtcccttgcggcatcagacaacagatggcataaatgccatctttatgtcgaacaaaacataaccgcgcgaagccgatgtctgagtcggcatctgccttattttcaatagcagatgccggcgagtttcggttcgcgcggttttatattgtctgtgaaaaggtgccattagggacaccagaaagtccgcccattgtctccggtgtgtcggacatgcacccgtcggattgtccaaacgtggaagagacacggaatccgatgcaaacattcggccggaagaaatgctcacatttttctccaacgaattttcctctgcatttccacatgaaatctgtaggtgtgtttcttataatatttaatattacttatcataaaaaggacacaacacacttcatgcgcgccccttccgctgcattgcgtcagccctgcttaggacagccacaggcacgcaagctgcaccgccacaatgctcaaaataacactggcacacacataccctatccccagtccatagcttccgttctggaacagctggctggtctcgagtgcaaatgtggaaaatgttgtaaagccaccgcagacgccggtctttagcgtcagtaccagaagcggcggaagcgaatgcttttctcccagaaccgccagcacgccgatgacaaacgcaccgagtatattgatcagaagcgttttgaccgggaatccgttggacgcgcccaccggcaccagtccgatcagatagcgcagcatggcaccgacggctcctccaagtcccacacacagacattttatcatatgaatctccctctccattccgcagacgttttttcgcaggaggaatcaccgttcaaatttctcccgttccttccaatatttttaatccgaaatacgattcaaggtcacatcatccaccgttccccagcttttcacattacacttgaagcgcacgccgattgtgagtgtactgtccgtcaccttaatttctctgaccgtcggattctgccagtcggcataggttgtcatcataaacggatctgtccattccgtaccgtctgccactgcatacaattccatcgaagcgtccactgacatatctccgccctgtgcgtacgccgaaagctgataggttccaggcgcaagatccgtaaattcctgctcgatggaaaagtccatatcggaatctcccgaccagaaatggaacgcgatatctccggtgtaggcatcatccgccttgttctggaaatcggtcggattattctctccctcgtaggaaaccttccacatcgaagtgtcctcatcctcaaagctcggatttaagacgtaattcaccatctccacttcaacctgtgccgtcactgccgtaccgtccgcaagcgttcccgccacctcgtagcttcccgctttgcccgtatcgatcgcagcaagctgctctgcatcccaggtcacgtcctcctgtgtgttcgccgcgcggtcattgtataccacctcaaccgtatccggcagcgtcacctcaccgcccacatcgcaggttaccgcaacctccgtaataaaatcgacggcaagcggcgccgtcgcaccatatttcaaatatttgaatacatttaatgaggcaagcgggtgccccgtaaaatcaaacatcgcctgattgtcccaggaacagcctccgtaatacagaccggcatcctccggatcatagtccgccgaatagatgctcgcccagccgcttccgtatttttcccagagggctgtgttatccgcatcggcatctccgaccggaatccaggtgccttcccagtaaaagacgccgagcgctcccgcctcatccgccgctgcacagatgtcgcggatcatcgtcgcctggctctgcaccgtcgccacatatccgtccaccagatcctccgtgccggcaaaactatttgcaaagccgtcgccgtcctctgtcgtatagcagtaggatgtctctgcgatatagacatcttttccgtaggtgttctcaatattttctgcaactgcctgcatattttccatcgttccatcccagtaaggataataggacagaccgaacagatcgtaatccacgccggcattctgcagattggcagccctggtgtccacttcctcgtaatcctcaatattggtataatgaacggcaaccttgatatcttttccgtaatcctttgcaatctcacgcaccgcacggcttcccgatgcaatcagatccatgaccgtatcgacatcctcctcgcctgccatgccgttgttgatctcgttgccgacctgcaccattccgacatcgacacccgcgtctaaaagctcggcaaggctttccttcgtaaaatcatagagtgcctcgctcttttccgacgcactcataccctcccaggctttcggtgcatgctgtctcttcgggtccgcccagaaatccgagtaatggaaatccacgcacaccttcatgccgtacgccgtcgcccgttttccaagggtgaccgccgtcgcaacgtcattgttgccgccgccgtacccgtttccatccgcgtcatacggatcattccacacgcggaggcggatataatttacgccggactgtgccagcgtctcaaagacatcctgctcttttccttcataattgtaatacgtcacgccgctgttctccagtgaaagtaccgcggacgcatccattcccaggataaaatcatccggcagatcggcgatcggctccacatagatctccgactcctccggtccatccggcagcgcaaacgtcgtcaccttattatcttctgccgccgtcttaatcccctccgagacctctgtctgcgcgctctgctctgttcctccattgctcccgccgcagcctgcaagcgccgttacggcaagaccgccgctgaccataagtgccagccattttctgtaattcctgttcccacacgttatcatcacttcttctcctgcaaaaaatgtagctgcgcaaccggttacgcagctacattttatcacataaagacgtttatttcaacctccgttctgccagaaccaccgtttgtcccgacatgctctgtgtttctctgatcggcgcaaactgattttttctccagaaatgctctgcctgcgggttgcccttcacccagcagagccgcacggtgcggattccttcctcagccagatgacgacacagatcctccacaattctggtgccgatccccgcctgctgaacagaagcctccatcataaaaagtccgatatacgccatcgcccgctccgggtaatcggcaatgagatccatctgtgcaagcagtgtctctccccggaaaaatcccacgtaatacttatcatcggggagttttccgggcggaagcgccacaagatctgacaggatgctgtctcttgtcacatacgggggacaatattcataatacagattgttcttccgggagagttcataaatagctcccacatcctgctctgtcagtgcgcgcacctgatatttttccgaccagcggctgatgtccattctcttacagcgtccccggatctgtccgtcttttccgacccagacaagcattccctcatccagtcccatgttccacacctgctgctcctccatgcgcaccaggcaggtttctccttgttcgtttaccagcgtgatctcatcatacgccgcttccccgtcatcacgtccttcacagccaaaatccggctcgtcaatcctaagaatccgatattgcttctgtccgtccttcattgtcgtatctctttctctttgttttcattctcccggcatccggtcagcctttataatcgatgtgtccgccgaccaagcgttcctctttcgtctgcaccgtattcatccgctcattctgctggtaatcgctgatcttttttaacagctccccgatacttgacgccgtgatcgtcaccgtattttcccagtctgcctcagacgcctcatctgtcttattcacacgctctgttgcatgttcatctctttgattttttccgtccctgatccgcttctcctgcgcttctttctgcgcccgtctcgcctccgccttcttttcttccgccgccttctcgcgctttttctcaatccgctccttctgcgcgtcggaagacttctgcagcacggcaaaataggtggcggtgccgccatcattcacctgcatgccgtagccttttacttttgtaccggaagcctccagcgaacttttcatctgtgcaatgccgcttcccgcattcgcaatgatcgcctcgtactgtctgcggtaattttcatcctccgccatgcgctcaatcttgtcctcgtcgatgagaactaccatcttcgatgcattggcatagcttcccgcctgcgcccttgccttctccttctgatcctcgctgaccagaataaagtccatattggaatattttcttttcagttcttcataatactttgccgctttttcgctgagtttcggattgccgatcgttcttccagtcaccgttccggtttttcctgtcctgtctgtcttgtccgccttattggctttcccggtcttctctgacgatgcgtttccatccgtcttttcttttccttttgtgtctgccgccttacggttataggacatggcacttcccactgcatttgcataatccggtatcaaactcatacaaatctcccctttcgccatttccacctgccgaaatccgtttcggcaggtctgctctctttactttatatatcggtcagatatgtccatcttgccattgcaaatttaaaaaatcaaaggtaagataaaaggagtatcttttcgggaggtctcttttcatgaaccctacagtaagcattatcgtacctgtctacaatgcaaaaaattatctgcagcgctgcattgacagcattctgcatcaggaatataccgactacgaactgttcttagtcgacgacggaagtacagacggctccggtgacatctgcgatgcttacgccgccgcagatgcccgcattacagtcatccacaaagaaaataccggcgtatcggacagccgtaatctcgccatcagccaggctcgcggcacttacctgcagtttctcgacagtgatgactggatcacaccggatgcgacaaagctgttcgtgcgcgccgccacagagcatgactgcgatctggtgatcgccgatttctaccgcgtcgtcggagagcgcgtctcgcacaagggcgatattgaggataacggtgtcctcacacgcgaagagtttgctgcgcatatgatggagaatcccgctgatttttattatggcgttctctggaacaagctgtaccggcgtgatcttgtggaaaaatatcatctgcgcatggatgtctcggtgaactggtgtgaggactttttgtttaatctggaatatattttacatgccaacgtcttctacgccctgcaggcgccggtctactattatgtcaagacaaaaggttcccttgcaagtcagggattaagcatcacaaagaccgtcaagatgaaattcatggtctttgaatattacaatgaattttataagaatgtctacgacgaaaaagtatacgaaaaaaagcggctgtccgtctaccgcttttttctggatgccgccagtgacggcactgtgccgccgacgcttctgccgggtgcaaaaaagcttggcacagagcgcatcccggtctgtccttccgcgatctccggagagggtatcctatcggagttctaccggagccgcaagcttttggaccgctgtctggaggcgatcgccctgcgcaatgatctgacgcttggcgagctgtccctcctgctgtccttaagccagatgcatacattttgcagccgcacggaacttgccgattttgccggattatccaaaagctcgctcgcgcgcaccctgcaaaagctttccgccaaagattatatccgcgtcaacagcaccagaaaatacctgcacgtggatctgcttccggcagcgactgcgctcctcccggagctcgccaccgcacaaaacgattttgatatggcgcgctttgccggattgagcgaggaagagctcatctgctatgcgaaagtgacggaaaagatcaaggaaaataccatgcgggtgctaggcgtctagcgcccggccgtgttttttagataccgtaacaaaaaagacaagtacaaactgcttttttgtacctgccttcttcgattagaatgaaattttcccgttcccttacgctccgagaatctcctttaagtctgcctctggtgtcgtgatcggtgcaatatggtaatgctccaccagatatgctaacacattcggggagataaacgccggaagtgtcggtcccagcttgatgttctggatgcccagatgcagcagcgtcaaaaggatacagaccgccttctgctcataccaggacaataccatggataacggcagttcattgaccgagcagccaaacgcctcggcaagcgccaccgcaaccttgatcgcgctgtacgcatcattgcactgtcccatatccatcaggcgcggcagaccactgatctccccgagatccagatcgttaaagcggtattttccgcatgcaagcgttaagatcacactgtccttcggggtctgttttacaaattcggtatagtaattgcgtcccggtctggcaccgtcacagccgcccaccaggaagaaatgacggattgcgccgctctttaccgcatccaccacctgatccgcaacggagagcaccgtgccgtgtgcaaatccggtcatcacctctttaccgccgttgatgccggtgaactccgtatcttccttgtaaccgccgagctctaacgctttctcgatcaccggcgtaaagtccttgtccgcaccgatatgcaccatctgcggataagaaaccacctctgttgtgaatacacggtcacggtagctctccttcaccggcatcaaacagttcgttgtatacagaatcggcgccggaaccccgtcgaactccttctgctgattctgccatgccgttccaaagtttccctttaaatgcggatactgctttaacagcggatacgcatgtgccggaagcatctcaccgtgcgtatagacattgattcccttatccttcgtctgctccaaaagcagttttaaatcgtagagatcgtgaccggtgatgatgataaacggtcccttctccacggtaagcggcacctttgtcggcttcggattgccgaatgtctctgtgttggcgcggtctaaaagctccatacactttaaattcacctcgccgacttccagaaccaccggaagcaggtctcccatctccagatcaaagcccaggaacgaaagcgccttatagaaaaatgcattgaccgtctcatcctcatagccgagcaccgccgcatgataagcgtaggcagccatgccccggatgccaaataaaatcaaagacttcagggaacggatatcctcatccgcctcccagatctccttcatgtcgtaatccgaggtattgccgcacggcgatgcgcaggtggcacagttcggaaccacgcgttccttctccgcatgaacctttgcgatcatctcacgcagtgtctcatcattaaagttgacattcgtgatcgttgtgaataatccttctattaaaatatgtgtggtgtcctcggtgcgtggattgttgccgcacgcctttgcaagcccgatcaacgcgccggtcagttcatcctgcagcgctgccgtcgcactgctttttccacagacgcctgcattcccggtgcagccgctgcatcccgctgtctgctcacactgaaaacaaaacattttatgttccatattgatctctcctttgatttcctgattgattacctacgcattgtatgaaatctccggagatttttctgttgtttttccaacaaaacaattcttttcgcttttatttttcgcaaagctccgacaggggatgaaacgtgtatcccatttcctcccatttggtcagcagttcatccagaatctccccgttcgtcttcgaggtgctgtgcagcagcacaatcgcccccggatgaattcttcccagcagcttttcaaacgcctcctccttcgtcggctgtgcatcgacattccagtccacataggcaagactccagaaaaaagtgtgatagccgagctgttttgccatctcgagattcttcgtgctgtattttccctgcggcggtctgtaatagttcgccatcttctgcccggtcacctcggaaaaaagcgcggcgttgtcgtccatctctttctggaacgcggtaagatccgcgatcgacgacatatcgggatgatgataggtatggttccccaccgtatgtccctccgccaccatccgcttggcaatctccggcgcgctctccagaaaatgtcccaccacaaagaaagtggcaggcgcctggtgcttttttaatgcatcgagaatcggctctgtattcccgttctcgtatccgcagtcgaaggtcagatagagcaccttcccggacggatccccgacatagtgtgcatcgtactgcgccaactccgcagaggttgcattgccggtgggctgggttccctccgcgccaaagccgagcccccagttgcccgcctcgtacgcgaccgccgccgtctcttttgtctgtctgctccgcatcccggcgatctcccacccggttaaaaacatcgcggaaaataaaaacgcaaggcacaggccctttttacaattctgctgcataacaagatcctgtctgttctcttgttatctatgtatatcggaaaccgccctgtcccatgacagaatcagccgttattctgatagccgcacttcgggcagacgccgccgcccttatactggtagccgcagcggaagcagcagattgtatcgtgcttctcgctcgccagataggtaagctttctggactccggcttctcctgcagataatgaataaaatcatcgagttccccggcatagtccggcagctccttcgtgccaaccgcataagggatctttaatttggttccgttcttctggtgcacgtaaagtcccttattgagcagtcccgtagacgccgtgacagacgcaatcgaggcgaccgggattccgtaggaggtaaatgccgtgctgtagtaaagatgctccggcgttaaaatcatcccctcttttccagacgcatcgcgcgccacatccaccaccagaatcgggtactcaaacagacctctgccggccgcataggacgccatggcatattcgatcacatccgtctcctccggcgtcgcctgcccaagcagcactttcctcgccggataaaaatgatgtctcggattctccccgacaccgttctcctccagttcttttttcagctttcccaccagaagctcacactcgtccgccttgattttggagagccgcttttcgagcgtcttaagcgcatccgtcttaagctccgggagaaaatctccctccttgatcttctggtatgcctctatgccctcctcaaaattcatctgcatcggtgccggacagattgctgcgatggcatccgcatccagctccctgatccggtcgttgaccttctccagatagggtgccacaagccccggaagaaaatctccctccctaagccgctctgcaagatccacgtagtcctccctgctcacttttctcgcgcgccggatcatgttggaaagttcctgcttctccgctgcctctctccccgccacaatcttctgttcgtatggtgtcagatccactccgtcgtaatcgtgcagccggtcgacatagagccggtactgcttccggtcgagattcgccggcatctttgccaccatcgccgccacttcgcgctccgcctggctctgtttgagctgctgcagcttctcccgcagcggatgcttctgttcttccggaagatccgcagcttccacttcctccaatacccgtttggtcagcgtgtagttcttcccctcacaggcatccgctttttcctgaagttcccggacacgcccctcataaatccggtcctgtatcttctttatatatggcttcttctcgtcctccgtcagcttgcgctctccttccagctgccgctttaactcctgcagctgccggtcggaatagcggtccatgaccgccagacgcgcctcatagtgctcctgcacgcttttccgttcttccggtgtgacaatgacgccgtccacggtcattcctccctccggcgtctgcgttgccgcatggatgtcttttccgcctgtccgctccttagcggcgggtctgcccgctccatccgcgtccggacgcaggctgcttcctgcctccgccgctctgcgatctgctccatgcatttctgcctccgccgctctgtggtctgctctgcgcgtttccgtctctgcagccataccgcgtccgcggtctgccggtcgtccactccctacgctgtctgtctccttccgccccgctgactgcttcgccgtctctttcggtgtccgcgttccagactgcttatccggttcttccgctgcctgttcccgctgcggcaaagagcgtccctcgtcgtgccgctctctctcccggctgtgcacttttgcctcgtatttttccacggattcttccggataaaagccctcctccatccgcgcggacagctttttcacctcaagatccgacaattccggcagtgcgttgcagagatcctccagggattcctccccgtcctcctccgtatccggccgtcttccgtcggcatagacattcgtgtgatagttggacacccggtcggcatttctccccaaaagctccagataatcgtcatacgccgcgtcgtccgtcgcaaaatccagcgtgtaaatatcgccctccgagaacaatctgccgggacgcggcgtgtaaaaccgcctgcaggcattgcaggtcgcggctctcgccagcagcacgccgccctcctccgtctcgatcttaaattcctttccagccggatagaccgccatatgcagcttgccgcagcatgccgggcagagataccccacgaggtaaaaattattcccgatccggctctttctccgctcgctcaccgtgatgtccgcccgggcgaactccgcctgagcgcgtttccagacgaccttgtgccagagtccgccctcgttcgtttcctcatcctccggctgtgcctgctcctcttcctgcgccgtctggataacatcctcataggtgatccgcattccgctccggtagaaacgcagataggacggcgtgtactccggttcgacctgcatctccttcataatgtccgtaaacagcgtatttaactgttcaaaacttttgtctacgcggacgcccttgatcgtcccccattttccgaatgcatataaaatcaggttgatggcattctgcacccgcatgttcgtgccgacctcaccgatctcgtcctcttttaccggtatgtcgatgatgttcgtcgccacattgcgcgtgtcaaaatggaaaaacagggaacgcacctccccctgtaaaatcatgtaattgtcaatcactacaaatatgccgttccatttgaccggaactttcatcgcctcaatcaggcgttcaaatgtctggtgcaattccgtatttgctctcaacagtatcatagacgcaacctcacttctcatccatcgctttctaccaacagtatactcatatatgaggcgtttttcaaatctcgcatgcaaaaaatattttttttcaagaaaccatcccctcactttataaacttttaataattccgctgtttccctgtttttcagccttccgggaatgttgttagcactcatgtgaaaagagtgctgattttgtattgactttttggaatgacggatataaactcttatttaaaagggaatgacgatgttactgtcgtcttccgttctaccgtacatattttatttttagataaaggagtgttttattatggcaaacaaacatggaagtctttcaattgacagcgataacctgtttccgattatcaagaaatggctgtattccgaccacgacattttctatcgtgagttgatcagcaacggctgtgatgccattaccaaattaaaaaagttagacatgatgggcgagtacacgctcccagctgatttcaaggcaaagatcagcgtcaccgtagaccctgaggctaagaccctgacatttaccgataacggtcttggtatgacggcagacgaagtcgaggaatacatctgccagatcgcattttccggtgcgaccgatttcattcagaagtacaaggacaagtccacggacgatcagatcatcggacatttcggactgggcttctactccgctttcatggtagcggacgaggttgagatcgataccttatcttataaggaaggcgccacaccggtacactggacctgcgacggcggtaccgattacgaactgaccgacggcaccaagacaacgatcggtacacagatcacgcttcatctgaacgaggactgtctcgaatttgcaaacgagtaccgtgcacgcgaagtgatcgagaaatactgctctttcatgccgaccgagatctaccttagcaaggcaaatgccgagccggaatacgagaccatcgacgctgctgacaagcgcgataccgatacggtcgtggaggagattcacgaggaggcaaagaccgaggaaaaagagaacgagaacggtgagaaggagactgtcgagatctcccctgccaaggataagttaaagattttaaaacgcccggttccgctcaacgacactaacccgctgtggcttaagaacccgaacgactgcaccgacgaggaatacaaggcgttctaccgcaaggtattcttagattacaaggagccgctgttctggattcacttgaatatggattatccgttcaacttaaagggtatcctttacttcccgaagatcaatacagagtacgattccatcgagggaactatcaaattatacaacaaccaggtatttatcgccgacaatatcaaggaagtcattccggaatttctgatgctcttaaagggtgtgatcgattgtccggatcttccgctcaatgtctcccgctccgctctgcagaatgacggattcgtcaagaagattgaggaatacatcacgaagaaagtggctgacaagctgatcggcatgtgcaagacagacaaggaatcctacgagaaatactgggatgacatcagtccgttcatcaaatacggctgcttaaaagaccccaagttctgcgacaagatgaacgactatatcctctttaaaaatctggatgacaagtaccttacccttccggagcttctcgtaaaagaagaggagaaaaaggaagacaccgatgctgcttccgatgttgttgacaagaacggcaattccgtcacagaggatgctgatgcaaaggacgattccgaagaggaaaaggacgagcgcaaggtcatctactacgtgaccgacaaggtacagcagggacagtacatcaagctcttcaaggagcagggaatggacgctgtgatcttagaccacaacatcgatacctccttcatctcccagttagagcaacgcaacgagcattataaattcatgcgaatcgatgcggatgtcacagactccttaaaggatgcagacgatgccgctgatttaaaggaagagaccgacacgctgaccgacctgtttaaaaaggcacttggcaacgacaagctgaccgtcaaggtggagaagttaaagaatgagaatcttgcttccatcatcactctctccgaggaaggcagacgtatgcaggatatgatgaagatgtacgctatgggcggcatgggcggtatggacccgaatatgttcgccgcagaccagaccttaaccttaaacgcgaaccatgcactggtcaaatacattttcgagcacaaggattccgagaacgttccgatgttctgcgagcagctctatgacctggcaatgctgtccaaccaaccgttgtccgtcgatgccatgagcaagttcgtggagcgcagcaacaagatcatgatgcttcttgccaaataaatcaattcgtcttctcacagacagcaggatggggcgcgaaattcactctatgcgggtgaatttcgcgccccgtcctgctttttctatcggaaaatcccttctctttcacacaattttcacactgttaattgaggtgcgcagctatgaggatcttgcagcatctgtctcctatctgaaggagcatcatctccatccgtttgatgagatgccctgacacgcagggcatctcattttacgagacaacaagggcaaaatatccccagtcccagatcagccgttcaaaactgttctccaggtattcccagatatcctcgtcttcatatcccagcatgcgcgacagaattaccatacagctgcgcatggtctcataggaaagtgcgccttccctgtgccagcacagaaaagcggcatgccggatggctgcatactctaatgcaatccactgcagctttaccgtcacatactcgacgtcgtccggctcccccagacactccgaaaaaatctctgactgcagatagcaccgcatcagtgcctcatatggagaaaatgcctgcgcaaatgcatcgagatcttccttacggatcttcccgtaatcttccgcgatctgttccgcttcctctgccgccggtgttaaaaaagtacggtacagcccttccttccggtagttttccgccagatccagaaacagctcattgcgctccacaaatgccgcccggcaatccgccccggcatgctccaccgcatcggcaagttcttttctaaaaggcgcatccccgtatttggggacttccgccttccatgaagttcccgcgtcgcacagatcaagcgccatgtaaaacagcatgcaaagactctgtgccggccggtacgcacggtctgacatgattgtgaggaaacgttttctcaccccatacaccgcttcatatgcgccgtaggaggcactgtctgcctcatccgaaaaccggatgcactcccgcccccaaagcagatccacgaccgccggacagcagggcatcagagaatattccgtgatccccgccacctcatgtttctcgcgcggaaacaccgtacaggtctccgacaaaaccgcatccccgtaagttaaaaccagccggcagagctttctctcatccagaaacggacagcgcattttttcatcgagcgtaatgattcgtccatccccgtatttttttgtataatcagataaggtccgtcttttcggacggaccccttccggcgtttctgtttttttccatgcggcagccgtcttacggtccaccgcaatcttccattcctgacagcatgtcagactgcacgcatccgcgatgcattgaaactcatcataataatcgggcttcatttcgttccccctcatgtcattctgccggcctcttatcagagaatcttcgtcgtccacttcgagcagtcccagacctctcccacgatatcctggtaaaactccggctcatggcagattaacagaaccgttccgcggtactccttcagcgcacgctttaattcttccttcgcgtccacatccagatggttggtcggctcgtctaaaagcagaacgttggtctctcggttcatcagtttacacaaccgcaccttcgcctgctcgccgccgcttaagactctcacctggctctcgatatgctttgtggtcagaccgcatcttgcaagcgccgcacgcacctcatactgggaaaatgccgggaactcctcccagatctcctcaatgcaggtgcgcttgttctcccccttgatctcctgctcaaagtagccgaccatgaggttctcgccctgctcgacaccgccgccaagcgcgggaatcagacctagtagactctttaaaagtgttgtcttgccgattccgtttgcaccgatcagcgccaccttatgtccgcgttccagtgcgatcgaaagcggcttcgagagcggctcctcatagccgatcaccagatccttcgtctcaaaaatatatctgccgggcgtgcgtcccaccaggaaggaaaactctggcttcgggcgctccgccgcaagctcgatgacgtccatcttgtccagctttttctgccgcgacatcgccatgttgcgggtggatacgcgcgccttattgcgcgccacgaaatcttttaattcactgatctcctgctgctgtttgcggtatgccgcctcaagctgtgccttttttaccgcgtagacttcctcaaacttgtcgtagttgccgacatagcggtcgaggtgctggttctccatgtggtagatgatattgacaacatcgttcaaaaacggaatgtcgtgcgagatcaggataaacgcattctcgtactcctgcagatagcgtgtcagccacgcgatatgctccgcgtccagatagttcgtcggctcgtccagcagaagaatgtccggcttctccagaagaagctttgccagcagcaccttcatgcgctgcccgccgcttagatcggtcacatcatggtgcagcccgagttctaagagtccgagcgctctggcaacctcctccacctttgcgtcgatcgtataaaaatcatgcatcgtcagggtgtcctgtatcacgccgagttcttccatcatggcatccatctgcgactcgtccgcctcgccgagcgcatcacagatctgattcatcttctcttccaacgcaaacagccacgaaaatgccgactttaagacactctcaatcgtcatttccgcggtgagtgtcgagtgctggtcgaggtaaccgacccgcacatttttcgcccactccacttttccctcgtccggcatcagctttcccgtaacgatatttagaaacgtcgactttccctcgccgttcgctccgacaagaccgatatgctccccctttaacaggcggaaggacacatcgtccagtatcgcacggtcaccgaatccatgcgtcaaatgttctacgtttaaaatactcatccatcacctctatttcagcagaaaaaagtacaaaagcaccaccacgccgagcccaatgcggtaccagccaaacactttaaagtcatgctttctgatatatccgagcaggaacttgatgacgacaaccgacaccagaaacgcgctgaccataccggaaagcagaaccgcccactccgtcccggtcagatgaagtccgaagtccatcaattttagcaggcttgcaccgagcatcaccggaatcgccagaatgaacgtaaactcactcgcagccttccttgatacaccgattaagagcgcaccgataatcgttgcaccggagcgcgacgttcccggaaacgcagccgcgagcagctggaacaaaccgatcagaatcgccatttgaaacgtaatgtcccgcatctgctccacgggcgcctgctttgctgcattgtgattctccaccagaataaaggcaacaccgaacacaatcagtgccaccgccacacacaccggattgtaaaacagtctgtcgcaggtctcatccagccccagcacaacaaatacgattgccggcaggcaggacaccacgatcttgcaccagttgataatgaccggcatgcgcaccgtgacgggacctaacacccagtattctctctttgcaagagaaccgctcttctcattctgttctgcggccacgactgcttccgaggaactgcgcgcaaacggccagatcagattccagaacagcaccacaaccgccaaaatcgctcccagctggatcactaccagaaacatatcccaaaactctgcgctcacatccagtgtcagaaactcgtttaagagaatcatgtgtccggtgctgctgatcggcagccactccgtaattccctccacgataccaaatataattgcctttaaaatctctgccataaatactccattcttctcataactgctatgcatcagccgctgccatgccacactcagccggtaccatgcctgcttgctatgccacgctcagccggtaccatgcctgcttgctatgccacgctcgtgcggacaggctcgctcaacattttcttcgtcttcttcaacacatggaaatatgccgggaacaggaaacagtcagcaaaaatccatgcgaccgggcttgcaaagcacgctgccggatagccgaacatcggaacaaacacaaatccgaccagggtacgcgccgccatctcaaagacgcctgccagaattgcaaacttgctgtatcccataccctgaatcaaaaagcgtacaatattcacgaaagccaacggaatgtagaaggcactgttgcataccagaaacagccttacatttgcaatgacctccgcctgtgcactctccacgaaaaacatggcaagctgattgccgcaaagccacagcaccacaaacgccagaatcgaatatccgattcccagaattcccgccgcttttaatccgccgctcaagcggtctaacttcttcgctcccacgttctgtccgccgtaggttgccattgtagaaccgagcgcatcatacgggcagcagaagaacataccgatcttgcttcccgccgtcatggatgccacggcattcgatccgagcgtgttgactgcgctctgtaggatcacgctgccgatcgcggtgatcgaatactgtaatcccatcggcacacccatgccgcagagggttttcatgtagcccttattcactttccgctcttcctcatcggtgtgcaggatctcaaactttctcttgctgtagatgacgcacgcgataccggaaaatgcctgcgagatcacagttgcaagcgctgctccggcaactcccatcggaaatacaatgattaaaagcagatccagtccgatattcacaaatgcagccagcgccagaaaaatcagaggcgtcttgctgtcacccatcgaccttatcacgccggacaccagattgtacagataggttgccggaatccccgcaaaaataataacaatgtaggtgtaggcgtcatcaataatattctccggcgtctgcatcaactgtaagatcggccggcagaatgccaccgtaaacaccgtcatgaccgcagaaaagatcaccgccagatagactgcattcatcataaacgcacgcattgccttataatcgccggctccaaaccggtgcgccagaggaatggcaaaaccgttggacactcccatgcagaatccaataatcagaaagttcagcgaaccggtcgatcccactgccgcaagtgcatccactcccagaaatcttccaacaatcagggtatccaccagattataaaactgctgaaacaaaaatccaaacaacagcggcaccgaaaatcctaaaatgagcttcatcggtgaaccgcttgtcatatctttcgtcatagaatctacctcatttcatactgtatctcagatctcaccgcaatacttctcaaataccgcaaaaaagctgttcgtctgaatactgccatccgtggtaagctcaattccatcccacagatccgtgttcagcctcgaggataacgatgcgacaaattcattgtagacatcgtcaaatgcttctttttcacgtttttccacaatattggacttattcgcttccgtcagctcttcattatatttattcaggcacttgataaaatagtatccatttccggcagcgatcattccggagacggcattgtcgtccagctgaaatgccacctcctccacctcgtcgggcagatcatccctcgataccgtcacctgaatcgccgacaattcgttataattgttggcgacggaggcaaaatcatccccctgcgccagcttctgctccacctcgtgcgcccggtcttcgtccgtgacataaatctgcatgatttccatcacgcgcgcctcatcgtcgctgacctcctcgttgacaccgttcgtcagtgaatgatacagcttctgcgccagcgcatagtgcgtataatactccgcaatatccgcctcggcgacgtccatataggcggtctcatcctccgagagggatgcataatattcctttgccgcttccgccaccttcgcagtctcatcctccgagagcgtcacttcctgcgactgtgccagcagatccatcgtgtatacacgggtgagctcctccagcgtgatgtccttcacatagtcaagcagggatgcgtctccaaagtcatgctgccagaggtcaatcgtatatgctgttccatagatattctgataatttgccagatatacctttgcctcctttaagctgcatgcagacttgtccagtgtaaacacctgcctgctgcttagcgttcccgagaccacaatatctttattgccaatctggcatcccgtaagagccattgacagcgcgcatacgcacgctgtcattcccatcgcccatctttttctcatcgtgaaacaccctttatctcaacatctacatgatatttttcaagatacttctcgccacagaaattccgttcgcggatgcctgctgcagtcctctcgtcacggacgcgccgtctccgatcgcacggagtcccttgacactcgtctcgaagtcagagtttaccactaccttattggagtagaacttgacctccacaccgtagagcagtgtctcatcacttgcaatacccggcgttaccttgtcgagagccatcagcatctcctcgatatccaccatgatccggtgcgggaatactaaggagagatctcctggtaccgcatcctttaaggtcgggatgaggttgttacggcacaggcgctcctccgtcgttcttctgccacgcttaaagtctccgaatgtctgcaccagaatcctgccgtcacagagcatattggagagctgtgcgatctgcttgccgtattcgatcggcgtcttaaaaggctttgtgaagttcttcgataccagaatggcaaagttggtattgttggtctttaaatccttggacttgtaggcgtggccgttgactaccgccagtccgttgtcgtagtattcggttgcaacctcgccggacgggttggtacagaaggtacgcaccttatcatcgaacgtcggcgtatggtacactaacttcgcctcgtagaggttctcattcaagaactccatcacctcatcgcgcacctcgacgcgcacaccgatgtccacagtgccgacctttgtctcaatatcatgctgattgcagatatgggagaaccagtctgcaccctcacgtcccacagcggagatgacctctgctgccgtgtatgtctcatccttgtcggtaatgatacccttgacctggttgtcctcgatgatgatgtccttgaccatggtgccaaactccatctcgaccccttcctctaacaggtgctcctgcagtctggaatagatcttgtagccttcctccgtgccgagatgacggatcgggcattcgatcagctttaggttcgccatgatcgcttttctacggatctcgcggatttccttctctttatccacaccgtacaccttggaatccgcaccgaatttcagataaatatcatccgattcctttaacagctccacggtcttatcgtagcctaaaatctccggcaggttgccgccgacatccggcgataaggacagcttgccatcggagaaagctcccgcaccggcgaatccggtcgtgatggaacacggcttgcatcccacgcataccttggtcttacgcttcggacattcacggttctcaatccgtcttcctttttcaatcattaacactttcagatcctttttcgcatgaatcagctcatacgcacaaaaaattccggaaggaccggctcctataatgatcacatcataattcttcattacattccctcgttctttctatatattctaccattctgttatgtatcttcctacgttctccaaagcagacggcttaagcttccacgatcaggtatcttccgtccggcagtgcgaacacttctgcctgctccgccagatcctcgctgctcattccggcgatatccgcaccctcttccttaaagtacgcccgcacttccttcagattctcacagaccgttgcgaaacagtccgaaagaaattcctccgcctcttccctgctttctgccacaggttcccgaaacagcttctcctgctgcgccaaaaatgtatccaggcacatttcatcgtacatatcttttcctccgccaacgttttattttaccataaatagatatcaattccaagcttctttaattcccggtaaatggctgctaccggaagccctacaacattattatagtcgccatcgattttgtcaacaaaaatcgcacatttcccctgaattccgtatgcgcccgccttgtccatcggctcgccggtggcgacatagcgccggatctcctcctcgctcatcgcgcgcatcgtgacatcggttttctcatgaaacatcacctgaccggcctttccggacgcatccaaaagcacgatcgacactccggtgtatacctggtgtgtgccgccggagagaagcttaagcatgcggcaggcatcacgctcgtctttgggcttccctaagatctgtcccccgcaggagacaatcgtgtcggcgccgatcaccataagatccgagggtgtcaccagttcctgatgcgtctcctcgtaggttcttaccatggatgccacctcgatggccttctgcgacgccagttcctccacgacttcgtgcggtacgctcttcgtgatccgctcctcacctttggccgggcagatttcaaacgaaatcccgatctgctctaacaattcctttctccgcggtgaggcggatgccagtatgatctgtcccatctctttttcttcctttctgatgttcttatctctgaaatctatcgtttcttatgttccatttacgttacaccggtatcactgcgcccagccggaacgagtagagaagccgctccttcacgcgaagcgtcctctcacttccgtggttatagatccgctccagcgcctcgccgtagagctttaactgcgaagcataacggtccgccagttccttgccggttttcacacggtccgtcttatagtccagcaccacaatgccgtcctcctcaatccagaacacatcgatgattccctggatcagcgtcagctctttgtcatccgcacatttctctccgtctccgaatccgaatgccgcgagctcctcgcccgtaaatcccatcacaaacggtttctcccggtacagcgttccggcagtctccgcacgcttcatccgctctcccgccgccgatgtgagaaacgtctcgatgagagccggttttaccaggcgcttcatctcctccgtgatctgtcctccggcaagcatcgcctcaatctgttccgtgactcctgccgccgccgaaaactggtagcactccatcaccctgtgaaccgcagttccgcgcagtgcaccctggttctgtccgccggtttcttcctgctccatttttttttggacaaacggcggaacataggattttccctccgtctctaaaaacgccgggacaacatccgtctcctcctccagaagcttttcccgcatcgcccgatgctttaattccgacacggaatatttgtttttgcgctccagatcgcgctcgtacggataggtgaatgaaaacttcccgtcaaattccgccacgtctgccgcatccgccgctgcaatgcgtgacagacactgttccagattctccgtctcctccttcatgtgacggctctctgcgtcgagcagttcctccgccggcacaacgcgcacctgatagcgtccgtgataggaaaacaccgccggaagcagccagtcgaaatagcctgccgcgctctcccggagcagatacggcagaggaacatgctccgtttccgggaaaagttcctcctgtgccgcttcccttagcgccgccagatcattttctgcatcttttctgcaccccgttaagatcagcttctccttcgcgcgtgtgaacgccacatagagcacgcggagctcctcgcccagattctccagttcgatctgctttgcgatggcgcgctttaatatggtcggcgtcttgatcctgcgctcgccgtcgatccagtcaattccgattcccagttccgggtgcagcaccatgcggcttctggtatcctgcttgttaaaatttcttcccagaccgcacacaaagaccaccgggaattccagtcccttgctcttgtggatactcataatgcgcacgacgtcctcattctccccgaccatgtccgcctcgccaaaatcaacatcgtatttctggagttcatcgatgtagcgcacaaaatgaaacaatcccttgtagctcgtattctcataggcgatcgccttctccaccagcatgcgcagattcgctctgcgtctggctcctgccggcatcgccgccgcataatttccgtagccgctttccttcaacacgatctcgatcagctcgtgaatcggggtgtccggcacaagcgcccgcagcctctcatacagcttccagaactcccacagttttttctcataaccttccgccaaaggttcttcactctgcgcaagttccctgcagcgtgcgagcacacactcacagaaaggcacgctgcggtcgtgcgccctaagccgtcccagctcctcgtccgtaagcccggcgatcggagacttaagcactgccgcaagcggaatatcctgtctcggattgtcaagaatccgaagcatcgcaagcaccgtctgcacctccaccgccgagaaatagccggttgctgacaccgtatgcgccggtattcccgcctcgttcaacacggcggcaaacgaatcggcatacccgcttaggctgcggagcagaatcacaatatcgctgtaacgcacggtgcgcagttcccccgtcgccttgtccgtcaccttctgctctgtcatcagcttccggatgcgctctgccacaagcttcgcctcatacagcttccggtcttcgtacccgctgccctctaagagttcttcggcactgtccgccacaagaatctccggtgcaaacatccctgcctcatccggcgcacaataatctgcgcccgcgtagagcgccgcatcctcatcgtatgccacattgccgagatcgcgcgccatgatccggtaacacacatcgtttgtcagatcaagcacctctgaccggctccggaaattcctgtgcagatcgatacgctgcgtactgctttcctccagcgtgtaggtatcgtatttttccataaaaagctccggtctcgccagacggaagcggtagatactctgcttgacgtcccccaccatgaacaggttgtacgctccgcactcctctctcgagatcgccctaagaagcgtctcctgcacatgattgctgtcctgatactcgtcgatcatgatctcctcgtacatgtcgcggaactcctccgccgcagcgcgcgcctgctttgtctttgcatccacgagaatctccagtgcgaaatgctccagatcgtgaaaatccaccagattcttgcggcgcttttccgctgcaaacgcctcggagaatgcgatggcaagacgcaccagttccttcgccatcggctctgcccggcgcacctgcccgcacatgacttccggcgatgcaaagaaatactgcttgttgatcttttttaccgtatccttcacctggtcgcggagttccttcacacgcgaaagcttccctgcatctcccgaaaagccgcggctcgacggcagcctgtcataagtgacggcggtaagcttttcgtacagttccagaaaattttcacacgccgccagtccctcgaactttgcgagatccgacgagatcaccttctcatagatattcggtccgtcttcctcccgcgtaagcacatgcgcgatgcgaagcttttttaccagatccgccagcaccgaccgcagatgcagcacgagcggctgcatccatggcgcttctgccatctcctgcacatccgatatctcatagccacagatgccggaagtaagccactccatcggccacgggtagctcatggagaactcatagagcgagaggatcatctccgccaccttcgcatcactcttccccgacacatacccttttgcaaatgccgcaaactccggtgtcatctgttcgtaattgctctccagcacgccgcgcagcacgtcctcttttaacagctttaactctccctcgtccccgatcctaaaatccggctccaggtcaatctcgtggaaatgattgcggatcacatacagacaaaaactgtcgatagtcgtgatctgcgcattgtggattaacgtcagctggcgttgcagatgctccgaatccggatgctcctccagcgctttctcgatcgccgccccgatgcgctcccgcatttccgccgcagccgcattcgtaaacgtcaccaccaaaagccggtcgatgtccaccggatgttctccctccgtgatcatcttgataatgcgctcgactaaaaccgccgttttacccgaaccggcagctgccgataccagaatgttgcgctttcttaaatcgattacctgttgttgttctctggtccatgaaacacccatctactgtctcttctcctcgcttcgcgtctctctcattttcgcaagaatcgcctcggcaccgtccggcttttctaacttccggtaagaaaagcccggtatccgcgcgtcaaatccgcacaccatgtgatacggacaataatcgcagccgcttctcccgtcgagttcatacggtgccgccgccacatctccgcctaggattcttctgcccgccttcgtcacggtctccttcacgtagtccgacattgtctcaaattcttccgtactcgccgtcttggacgtcgcttttaaggaaccgtccgctttaagcgccacaggaatgactgcggagcttccggaaagttccgtatccatcgccccgtatatctcgggatcgtcgttgactaacccgttcggctttaattcctccagcacggcctgccggatctcctcctccgactctgtgccgctgccgtcaaccatgggatcctcaatgtgatagtaaaacattcccgcaggcaccgcctgttttcccggatgcttttttgcctccagttcgagcgccgcattcatataaaccaccagctgcagctgcagcccgtgatacagattcagcagggaaaatgtggtgttgcccgatttgtaatcaatgatctttacatacaccttatcgtccgtctcacaggtatccacacggtcaatcctgccccgcagacgcattttttcctcctctgtcagctgaaagcggattgcctccagatgatcggcctgcgaaaacgacacctcaaaatcactcggcgtaaaacgccccttctgcacctggatcgtgagcgcccacaccgtgcgccggatcgtgtctttcatgcacgacagcagatagcggttcttcgcctcgtcgaatgcgcccacattcgcacagcccgcaatcgcgtcattcatgctctcctcaatccacgcctcacgcgtctgttcgggcagatcgtaccaggtatacgaagacctgcggatgcgctccgcaaaatgccacagcgcgtcatgatagatatttcccatatccacgccggcaaactcctgcagttcccgctgcgacagtcccagtccgtaggtcatgtaatgcgcaaacgcacactccgcaaactgctccagccttgtgacactgttctccagttccgtgccgtataaggcgcgcgcaacctcttttccgatcggctctccgctgtaacggtaaaaagatgccgcaagcaggcgcagcgccttcgcatgataagtctcatccgagagataccactttgcaagcgccttccaggtatgtgacttttgttctgtccagagtccctccaacagataatcgatcccgctctccggcgttaaaatcgcggacgcctccgtctcctcctccggctcacggatctttagttccgggaacatattgcagagcgttccgatcagataagaccggcgcagcgcctttccctccggactgaccctcgagtaggtgacatacaatccgtccgacggcttggttaagttcagatacaggtaaaacttctggataaaaactttttcccgcgcccccggcgctaacatcagatgatgctccgccatcttctcgcgctcgaactgtgagatgatgcttccggtgctgccggctttcggcacgataccgtcattgacccccacaaagaacagaatccggatatgatttaatctggtgcgttcaatgtctccgaccgtcacgcggtcatttcccggcggaatcataccgacctttgccgcagaaaatcctgcgtccagaatatctccgtactcccggatcgacatctgctcctccccgagcaacgatgtaaccttgtcaaaaagatccatcacgatcttataaatctgaccatactcctgcgctctggtctggttcctgcgcacgccgttgtactccgtctcctccgcctgttctaagaggaactgcttctccttaagctgcgcttcaatatccagcgccgagataaactcatacagtccgtaggtctgctccgcaaccgtgtgttttttcccggaaaaaagtccacacagcggctcaaatgccagaacgatccgctcccgcacccggttcaaaagagccatctcctcctgcgccgcctccggatggcaggcatcccgcttcgtcacagacgtccatttctcgctccagcgctttctgccgcggattccctttgcaagcacataattctccaggcggtcaatcacatcctctgcatccgcaccggctccggctccagcgccgtcctcatcattcactccggctccggctccagcgccgtcctcgtctgccgtctgctccgtcttattctccgtcagaagccgtcccgccagtccgctccgaaggaagcggaacacactctgataggagaaatcaaactccacgacctcaagcgccgcgcggataaactcgatgaacgggtgaaacagaatgtttctcgtctggtcgataaaaaacgggatcccgtactgtgcaaacgtctccggaacgtagttggcatactgtggcacgtctccggtcaccaccgcaaaatcccggtaacggtagccctttgtccgtaccagacgcacaatctcccttgcgacaaaagaaagctcctggcgcggatcctttaagctggtgatgctgatgtcattaaccggcttccgccacttccggtacatcggacggaacagattctgttccatgaaaaacagctccggtgcattttcatagcgcctgtgctctcccggctccataatcaccggagagagtacctcgcatcccgcatccgccgcaatcttaagcagtgtctgtacggtctccttgctcatggaaaaaagctcgtgcacgcctctgctgtggtaaaaatcctcccggatatccatggagagcgacacgatgacgcggtcggcaagcggcagcatcaccctaagcagccggttctggatcggggtgaatcccgtaaattcgtcaaagacaatcacactgtccctgatgagctcggattcctccgccacctcacacaagagcgtcagaatctcctccgccgtgatgtatttcccgtcaatatactcccggaatccctcatacatcgtaagaatatcctgcatcttacagcgcagggtatccccgacatcctgcgcgcctagaaaagcgccaagatcctccggcgtgatattgtactgcgccatctccgagatcagggacttgatctcgccgatgtatcccattttgttgagattgccaccgagcaccgagagttcctttttcttaagctccgccaccttgcgcagcaccagattcttgcccgtctcctctaaaatgaccagatcctgcattccgagatcgtcaaacacacggtacgccagacgcacaaaactgagcacatccacgttcatgatggcatgattgggctgccgccacacaagttcgcgctgcgtctgcatcgtaaattgttccggaacaagcaaaaggaaattcttctccggttccctttccgcttcctccaatatcgactgatataaataatcggactttccgcttccggaattgccgaacacaaactgtaatgacataaaaaacgtgccccctgttcacagcaatattttaacacaggtgcacgcttcttccaaataatattctctctattttctcttaattatttctgatgtcagccgatatatatagtagagaaggaactcattaacccctatcagttgtgatttatttgtcaaggaggatgattgtcgcaatctactatgatagtgttttcgtgttacccgttcaccccgtaaaccggatcgaccggcttgcaccagagagcagaaagcagcaacgttccaaacagcagccttcttcttcgttcgccacactgctgcatcaggcaatgacggtgacagaggaggatgatgttcattcgttcgatgccactgcctagagaaaggttctatgaatcagacaaaagaatttcataagaaggcccccggttgacaatccaaggtttcgtacctttccattgcgcccgggggttttcttatgcctgcaggcaggcttctcttttatttttcatacaggaattcttccggcagggtcacatgaaaatcctctgccagatgtctgaagtcgtccggctgtatcgtctggagcttatccggacgcatggagagcgtcttcaccagaatctccgcggatttttctgcggtgtgcatcagaccgaacgttaagtcaaagtcctcgccggcagcaaacatgccgtgatgcgcccagatcgcaagatcatattttttcatcagctcgctggtcgcaaccgcaatctccctgccgcccggaaccatccacggcaccacgccgacacccgccgggaataccaccggacattccgttgccatctcccagagttctctcgtgaatacgcggtcctccagtggaagcacgaacgtcagcgcaatgatattggtggtatgcgcgtgatagaccacgcggtacttcggattctgcagtttctttacctccaggttcatcagatggctcggcagctccgaggtcggtcttccgccgtttaccagtccccacacgatccggtagttctcgcccttttcatccagctcaatcatgcagatcgaatcttccggctttaagatgacgttgcggaaatattttccgcttccggtcacaaggaaatactctcctgccagattgggcaccgtggtgccgatcggctgccactccttttcctgaaagttctcccgcaccgcttccacttcctccggtttcacgcggtaagataagtttccgccgtttctctcatgccagccctgctcccatccgtcgtttgccatgcggataaatccctgtacaaattctgcatccaaaaatttcatgattctcttcctctcttctctctgattcagcttctatctgcttatcctcttttggtcagtacctcacgctcgtaacgctcgatctcgtcgtagaaatgaaggtcgtcgcacacgccttccctgcggcagtattcctcccagatctcgccgatcggaagcatttttaccgcctcatgcataaccatgagttttcccagctgattcgtatcctgcagctcctttaacatttcattcggcgtgcacagtgccgttaacagggctttctgccagctccgaaagcctgttgcaagcgccaggacacggttgatgctcgcatcaaagtaatccagcgccatgtatacacggtcaagcgcatcgtttcttacgatctcttttgccatctctttcgtctcgtcatctaagagcagcacatgatccgaatcccatcgcacgcctctggtaatgtgaagcgcaaactccgggtaaaaacagagcatggcaggaatcttgtccgaaacatactccgtcggatgataatgtccgttgtccatgagcggcatacagccttcatgctgtgcggcgaagctcaatgtaaattctgccgaacccacggtgtaagactccacaccgataccgaataccttggattccacgcacggcttgacgagatttctgtcatacggttcggataaaatctgctcgatcgaatccttgcagcgcagacgcggtcccatacggtctgccggaacatccttaaatccatcccccgtccagatattcatgacgcacggcacgccggtctcctttgcaaaatattctgagatgcggatgcatgcctttccgtggttgatccagaactttctggtctcctcatcggggcttgataaggtaagtccgtcttttactttttcgtgggagaaaaacgttgggttgaaatcaattcccatatggtgcttcttcgcaaattccacccactttgcaaaatgcttcggctctaaggcgtcgcggtccgcaaattctcccggctcaaaaatcgcataggacgcatgaatatttaattttgccgttcccggcatcagcttcattgcctcctccatgtcctccatcagctgctgcggcgttctggcgcgccccggatagtttccggtcgtctggattccgcctgtgagtccgccgtcattgtcaaatccgatcacatcgtccagctgccagcagtgcagcgatactggaacctttttcaaccgctcgatcgcgcggtctgtgtccacgccaagtgcctcatactttgcctttgctgcttcataacctgtcatctcgtttctcccttctctccttcaaacttctccattgcaaacgaatccgcaatgcatgctctcgccgccctgaggtcttcaaattctcccgccgcaatcatctgcgcggcaaggttgccgagcgccgtcgcctccgtcggtcccgcctcgaccgtctttccggtgtattctgcggtaagccggtttaaatactgcgcattcgcgccgccgcccacaatgtgaatctctgggtactgttttcccatcaacgcctcgatctcctctgccgtcccggcatagcactgcgcaagactgtggtagatgaccgccgccagttccccgatggtctgcggaacctgctcccccgcttcccgacatgccctccttacttcctccgtcatgttcttcggcgccagaaagcgcgcatcgttgacgtcgatacgcgatgcaatcgtctcctttgcggcgcgcgcacagatctctccaaacccaagttccggcgcactctcctttcggacagactggatcatccagagtcccatgatatttttcagatagcggaaccggcagtcgtaaccgccctcgtttgtcatgttgtgctctctcgccgcactgctgcaatccgccgtcatccgttcggttcccatgagcgaccatgtgccggagctgatatagagcgtctcttcctcctgcgttggcaccgccgccaccgccgaggcggtatcgtgtgtgggcggcaggatcaccttgcaggaaaatcccacttctttctggatctccccccgcaggctccccagttcataccccggcatccggatctcctgaaacagccgtctcggatagcccagctgccggatcagctgctcatcccagtcctttgtcaccgggctgaccagctgggtcgtcgtcgcattggtatactcctgcacctttttcccggtcagaagaaaatgaaaataatccggcatcatcagcagacagtccgcctgctccagccattttggatgctgctcttttactgccgccagctgatagatcgtgttaaaaatctgtttctggattcccgttctgcggtagagttcttcctccgtaatgtgcgcatacactttttcatccatgccctgcgtcctgccgtcgcggtaggctgccgcatctccgatacgtcttccctgcccatccaaaagtacatagtccaccgcccaggtgtcaatccccatgctgtgcggaatttttcccagtctgacacactgcttcatgccgtttaaaatctccgcaaacagccgctcgacatcccataccttgtgcccgttcttctccgtcattccgttcgggaaacggtagatctcttccaataccagcttcccgtcttccagatgggacagcatgtgccgtccgctcgacgctccgatgtccaccgccagataatacgtcgtctccatccccctgctcctttctctttccttctcatttctgctgtcagcataacaaaaataaggacagttttttaggctctgattcgactaaaaaactgtccttattttccattctcaaatgttctctataattctctatgatttttcatcaaggttcccggcatcacgtaaattcatcatgcggtacgcacgcggcgtcacgccgtaccggctcttaaactgccggaaaaaataactcagattctcatacccgacatcgagcgcgatctcctccaccgccagatccgtctccttaagcagatgcgccgccgtctcaaatctccgctgctgcaaaagctccttgaacgtatcgccggttttctgccggatcagcttacttaacaccgagaccgactggtgggtatcttttgcgatcttcgtcagattcgcatttttgcagtcgctcttgatgtacccgagcaccgcctgcacgatcgtctcccggtaatccatcgaggaattgtggcttaaattctcaaggtgattcagaagatataaaaataccagtcccatcgtatactggttcatgacatcctcatcggaatgttcatgcaacatggattcgatcatattttccatgagattttccacctgcggctgctcctttaagcggaacagcaggtagtgcgataccggatttttctgtccgaaagcgccggcgataaattccgcaagcacatttttctcgtgcagcatggaaagcggcacctcaaaaaactccggcagcgcgataaaattgatgccgatatcctcatactctgccctgcggatagcatggcgcacctgctggttcaacatcagcacatcccccttgtgaagcgtcagctccttcccctcaatgatgtgcgtgatgctcccctgcacgacatacatgatctccacataattgtgccggtgctccgggaaatccacaaagcggctgtgcgggcgcacggtgatgagccgtccccgctttaacagcagatcccggtcaatctccccgatcgactctctcgcatacagctgacgctcgaccattccctgtcccgctctgtactttttttcttcctctgaaatgaccatcagttcgttaagaagttcttctctcatcgccgctctgctgcccttctgtaaaactctgcgccccgcctgccgttgtcaccagcacgtctgctctcttctacaattatccacacaggccacacccgttgtcaagtatcagacttctccgaataaaaaaagtggatcttaccaccgttttccgtgataaaatccacttttccttattcctgattatttgtttttatttttccagcccgaagcaatactttgtcaccgagcgatacgtatcgcccgcttttaacaccggtgatttgaaattcttctcattcaccgcattcgggaaatactgcgtctccagacagaatgcatggcgcttgccgtactgcacgccgcccttgccggtctgcggcgtgataaagttgccggtatagagctggatccccacacagtccgtatacacatccatgcagatgccggactttgcacctctggcgcgcgcagcaagctgcatggtgccgtccgccttgtccagcgcataattgtggtcataaccgcccgcataacgaagctgcgtatcgtccgcttcgatgtcccgtccgatctccttcatctcccggaaatcaaacggcgtcccggctacttttgcgagttctccggtcggaatcgccttggaatcaatgactggcgtatagtaagatgcgtgaagttcaagcttctgcccttctatcacgccggaatcatgtccgtccagattaaagtaggcatggttcgtaaagttcgccaccgtcgtctggtcgcagactgcctcataggcgatcgcgacctccccgttatcgtccagcgtgtacgtgaccttcgccgtcatattgcctgggaaatcctgttccccgtcgcggcttacataggaaaacgtaatactctgtgcgctctcctgcaccacatcccagatcactgcgtgaaaaccgtgcgatccgctgtgcagattgttctcgttgtcatttgcttccagcgaatagtcttttccgtccagatggatgtgtgcatgatcgatccggttcgcattgcgcccgatcacagctccgaaatagcaggtattgttctgataatcaacgggtgtatcgtatcccagcacaacgtcatatacgtttccgtctgagcccttcattgtgatcgatacgatcgttgccccgagatcaatgacagaaagcgtcattccctgcgcattgacaagcgtgtactccgtgacctccctgccttcctttgtttggccaaagcttcgtttttgcatactgatcctcatttctaagcatatttattgcgaaacggcagaccgtttcttctgacgtactaattctgtccgtagtaggcatttgccccatgcttgcggtagaaatgcttttccttgatacaatccggcgccggcttcaccttcggattgataagctcggtgttgcgcgccatcttcgccacttcctccagcacgaccgcattgtggactgcctctgcggcatccttaccccaggtaaacggtccgtgattcgcacagagaaccgccggtgtgtacatcggcttgatgcctcttgtctcaaaggtctcaataatcacaagtccggtgttcttctcatatgcctcgtcgatctcctccggcgtcagatttctggcgcacggaatcggtccgaagaaatagtctgcatgcgttgtgccgtaaagcggaatgtctctgcccgcctgcgcccacgcgacagcctccggggaatgggtatgtacaataccaccgatctcctcgtactttttgtagagttcgatatgggtcgccgtgtcggaggacggcttatatctgccctcgatcttatttccgtcaagatccatgactaccatatcgtccgggcttaaggcatcataatccacaccgctcggcttgatgacgaaatagccgctctcgcggtcgattccgctgacattgccccaggtgtaggtaatgagccctctgcgcggaagttccatgttggcttcatagacctctttttttaattcttctaacatctcttagtttcctcctgtgctgcgccgttctacttcatctcacgcaggatgcggtttgcgattccctctgcatccagttcgtatttgtgaagaagttcttttgccggaccggattcgccaaagacatcgttgacaccgattctggtaatctttgtcgggcatttttcaccgagcgtctccgccactgcagcgccgagtcctccgatgatggaatgctcctccaccgtgaatacgcgccccgtcttttttgcagtctttaccacaagttcctcgtcgagcggcttgatggtgtgaatgttgatgacttccgcatgaatgccctgctctgccagcgtatccgctgctgccagtgcttccgagacacaaagtccggttgcaatgatggagcagtcgcttccctcacggagcgtcacgcccttgccgatctcaaacttataatccgcgccgtcgttgatgaccggaaccgccagtctgccaaagcgcagatacaccggtcccacgtactcgtaggcagccttcactgccgcgcgagcctcgatgtcgtccgccgggttgatgacaaccattcccgggatcgcacgcatcagggcaatatcctcgttgcactgatgggtcgcgccgtcttccccgacggaaattccggcatgtgtcgcaccgatcttcacattcagatgcggatatccgatggaattgcgcacctgctcgtaagaacgtcctgccgcaaacatggcgaaggtgctcacaaacggtacaaatccacatgtggacattccggctgccacgccggtcatattcgcctctgcgataccgcagtcaatgtggcggtccgggaatgccttcttgaacattccggtcttggttgccgctgcgagatccgcatccaagacaaccagattctcatgctctcctccaagctcgaccaaagcattgccgtagctctctctcgttgcaatctttacttctgacacaatgcttcacctgcctttctaagatcctccatcgccactgcgtattcctcatcgttcggcgcttttccgtgccagccgacactgttctccatgtaggagacgccttttccctttacggtgtgcgcaatgatcgcggtcggcattcccttcgtagttctcgcctcatcaaacgcccgcttgatctcatcgaaatcattgccgtcgatgttgatgacgtggaaattaaagctctcgaacttcttgtcgatcgggtacggcgagcagacctcgtcgatcggtccgtcgatctgcaggttgttgttgtccacaatcacgcagaggttatccagcttgcggaaacctgcgaacatggcagcctcccagatctgtccctcctcgatctcgccgtcgccgcaaagtgcatacacacggtaatcctgctgtttcatcttccctgccagagccatgccgcacgctgcggaaagtccctgtcccagagaaccggaagacatatccacgcccggaatgtgcttcatatcaggatgtccctgtaaatacgatccggtatggcgcagggtcaaaagatcctccaccggaaaataaccgcggtttgccagtgccgagtaaagtcccggcgccgtgtgtcccttggacagcacaaaacggtcgcggtcctccttcttcggatccttcggatcaatattcatctcttcaaaatataaataggtgaagatatctgctgctgagagtgatccgcccggatgtcccgccttcgcgctgtgcacggacgatacaattcccttgcggacttcaacagccatcttctgaagtgccagcttatccatagttcccccttcatgcattctttgtcattgctactgcaaaactttgtcatcaaataccgcagagcatcttcggtaattagtcaccaaatacagctctgtagtccgcctggaatttctcaattcccgcatcggtaagcggatgcttggtcatctgctcaataactttgtacggaaccgttgcgatatgtgcgcctgctaatgcacagtctgtcacatggatcgggttgcggatcgatgcagcgataatctcggtctcaagtccgtagttgtcgaagatctgcacgatgtcctggatcagatcgatacctgccgtgctgatgtcgtcgagtctgccaaggaacggagatacataggttgcgcctgcgcgcgctgcaagaagcgcctggtttgctgtgaaaataagcgtcacattcgtcttgattccctctgcggacagcactttgactgcctttaatccctctacggtcatcgggatcttgactaccatgttcggatggatcgctgcgatctcacgtccttctttgatcatgccttctgcatccacagtggttgcttttacctcgccgctgatcggaccgtcaacgatcgtcgtaatctccttgatgacctcgttgaaatctctgccctctttggcaatcagagacgggtttgtggtaacgccgcagatcactcccatatcatttgccttgcggatgtcctctacgtttgctgtgtcaataaaaaacttcatattcctctccctttctgcgcttgtgcgcgcaccctatatgtgtatccgggtctgccccggtaccattctcatttaccgggggatgccgttttgacatccccgtatgcttcttattgttttttagcggtaaaacagattgccaagcatcagatccttcttgaactcgcggatctttgtatccttgtcaatataaactgcctcgatgcccatggcatttgcccagtcgcccatctgctctgcggtgaggtcgtaggtaaatgcggtgtggtgtgcgccgcctgccaaaatccatgcctccgcaccggtgtagagatccggctgcggtgtccagtaattcgttgctaccggaagcttcggcatcggcttctctgtcttcttacagtccacatcgttgatgatgagacggaaacggttgccgagatcgatcaaggatgtcgcgataccgcttccttccttggaggtaaataccagtctcgcagggtcttctctgtcacccatggaaagcggctggcacttgatggaaatcgggccgtctgcgatggacgggcagatctcaagcatatgtgcctcgaggattccctctttgccttttacgaaattgtaggtgtaatcctccagcatggaagtaccctttgcctccttcttgcctgctgtcataatcttcatcaggcgcaccatcgctgccactttccagtcaccctctgcgccaaagccgtagcctttttcctcgaggcgctggattgcaagtcccggaagctgctttaaggcaccgagatcaccgaagtgtgttacgattgcctgataattcttctcgtccaggaaacgctcgaaaccgatctcgatctgtgcctgtacggctacatggcgtctgaactcctgcggatcacgtccctctaataaaatgtcatatttgtcataatactcatctaccaaagcgttggtatcggactcggatacagctgcaactgcctccgcaatctcgttgaccggataggtatccacttcccagccgaacttcagctgtgcttcgaccttatccccctcggtaacagctacgtttctcatgttgtctgccacacgcatcacgcggatatggctgctctcgatcacgccgactgctgtgcgcatccaggatgcaatgcgctcctgcacattgacgtcgctccagtgtcccacgactaccttgcgctcgattcccatacgtgtcacgatatgaccgtactcacggtctccgtgtgccgactggttctcgttcatgaaatccatgtcgatggtgtcgtaaggaatctcctcattgaactgggtatgtaaatgaagcagcggctttctgtactcctgtaatccgagaatccaggactttgccggggaaaatgtgtgcatccatgtgatgacgcctgcgcactcctcatctacatttgcctcgttgaaggtcttacggatcagttcattggtgatcagtgtcggcttccataccacttcatacggaagcacgccggactcgtttaactttgccacgatgattttggaatgctctgccacatgtgcgaggcactcgtctccgtaaagatcctgtgatccggtgcagaaccagaacttgtaattttttgttgctaacataatgttccctccatgaaatatatttatgtttcagcagtaactgctgtgtaaatcccaatctgtaagcagcggcagcatctgccgctgcccccgtatctgtctataacggcatcgtccaggctgccgccttcgtgcctgtcttataacggcatcgtccgggctgcctctttctctgttgcaagcgccgctttgtacgccttgatgtaagcgtcaaatcccgcaacatccgccggatccggctccatcacgcttccggactccccgccgaagactttttcggagaggtactgctccaggctctcgccgtccgctttctgcagcatgtaggatgccagcagcgccatgccccacggaccgccctcgccggctgtctccatcactgccaccggcgcatccatcgctgcggccaaaattccctgtccgacgcccttggtcttaaagagtccgccgtgtccgtagatgcgatccacttttactttttcttccttcagcagaatatccagaccgatctttaaggttgcaagcgctgcatacagatgtgtccgcatgaaattggcgagattaaaatgtgcatccggcttgcgcacgaacagtggccgtccctcgttcactccggtcaccggctctcccgagaaatagttgtatgccagaagtccgccgcagtccttgtcaccctccagcgccttattgtaaagctttccgaaaagctcgttcatatcgacattgattccgaagttctccgcaaactcccggaacagaccgacccaggcgttcagatccgaggtacagttgttgcagtgcaccatcgccacggtatcgccggacggtgtggtcaccatatccagttcctcgtgtaccgcctttaagtcttcctctaaaaccaccattgcaaacacggatgttccggcagatacatttccggtgcgcacagccaccgaattcgttgccaccataccggtaccggcatctccctccggcgggcagagtggaattccggcttccagcctgccgctcggatcaagaagctttgctccctcctctgtcagtgttccagcattctcccctgccacgagcaccttcggaagaatctcctctaacttccatgtatatttccctaccgcaggaagcgcatcaaactgtgccagcatcttccggttgtaatctcttgtcttcgcatcgatcgggaacataccggatgcctctccgactcccagtaccttctccccagtgagtttccagtgaatatatcccgcaagcgtggtaaaatatgcgattttatccacatgctcttccccgtttaagattgcctgatacagatgtgcgatgctccagcgctgcggaatattaaacgagaactccttcgtcagtgctgcggccgcctcgcccgtgatggtatttctccaggtgcggaacggaaccagaagctcccccttcccatcaaacggcatatagccgtgcatcattccggaaaatccgatagcaccaagctttgtgacggcaacaccgtatttgttctgtacatcctcggtcatcttgcggtagcagtctctaagaccgtcccagatcatatccaggctgtacgtccagattccgtcgaccagctgattctcccagtcgtgcgcgcctgacgcgatcggctgatgtgtctcgtccaccagcactgccttgattctggtagaaccgaactcaataccaagcaccgccttcccgctctcaatcctctcctttgcgtttcccatgtgtaacaaacccctttccgaaaccatgccgcatctctcatacacccatgatttccctgcactcatcttgttgatgttatcttaagcataaaacttgtatgctcgtaataacaagttgttttttattcatttttatatcgtgtggttctctattttttatctatccggaaaacatgtacaccgtgtgccgggatttcatccgaaaggcagtcattgtgcacaatgagttccgttccatcccagagttcccgcgcacggatggttcctggctgcccgcacatgtctgcaaacgcttccgtctccggcaatgcagcctcacactgcgccggctgctccataaagttaaacagggcaagataccgttcgccctttttttcattaacacagctccagaccgcatgccgcaaatcgcgcgccacctgcctgcccacatagtctgcatcgagcatctgcaatagttcctgtctcgtcagaagaaaacgcgtccagtcatccagcttcgtcagttcaccgccgatcattaaaggcgagccgaacatacaccagagcgtcatcatcgtcttctgctcatccctcgtaaagtttgtctgccgctcctgcccgaacccttttccgagccggccgaccggcagcatatcgcagtccggaaacgatccgcagcccacatggttctgccacagttcacagcgccggaacatgtcgtagagcagctcccacgtatcccagaaatcatccgtgatgcgccacatgttggcataggtttcataatgccatgccttttcgatcagcgccggtcccggcgacagggagagcacgatgtcccggccgcacttttcaatcgcatgctgcagcatttcgatctcatgcgccgccgaatacggatgttccacgtacagattggtattgcagatatcatcgcatttgataaaatccacaccccactgtgcgtacagcgccacgatggaatcgtaatattcctgtgcgcccggctctcccatacggatgccgtacatgtcgggattccacttacagatcgacgacggatccgctatatcgctcgccagcgcgtcgcttcccaaaatcggcagatgccggtgtgccgcttcccgcggaattccccgcatgatatggattccaaactttaaccccagcccgtgcacataatccgccagcgcccgaaagcccacgccgtccttcgccgacgggaagcggtccgtacaggggagcagccgcccgtactcatccatcgacacctccccaaacggaatatactgatacttctccctctgacttccggtgttctttgcataccactggatgtccaccacaatatattcccagccgtacggttttaagtgcgccgccatataatccgcgtttgccctgacctcccgctccgtcactgtggtgtcgtaatagtcatagctgttccaccccatcggggcatgtttcatccggtatttcatgcttctctccttctcttccccattcacgatatttcctatagaacacaaaaagccgctgcagatgcagcggctttttgttgtcatacatcctgcttccaagtgtatgacttgtactttcgtacttacaagttgtttttatcgtcctgtgtcatgtccgtatcgtctcttcttctgcaggattcccgaatcacaagttccggctccatcaagacgcattttccttcgatattggaattcccctcccggataatccgaagcagcagttcggcggctgccgctcccagttcctcctgcggatgggagatcgtcgtcaacggcacgcggcatgtctgtgccagataggaattgtcataccccgtcaccgaaacatcctggggcacggagagcccctcctcattcagcgcgcggatcacctcgatggctacctgatcgttgtacgccaccaccgcctcaaacggatgattgccgcgatctctcgccatctgcctgatccgctcaaacggatgggtcttgcggtcctccgtgtagaaccagatcaccttatccggatcatacgcaattcccgcttcctgcaatgcctgcacataccccttgtggcgctgctgtccctgcgtgtcgtcggatttgaagacgcccacaatgcgccggtgtcccagttcaatcaggtatctggtcgcaagataggcgccccggcagtcgtccaggagaatctgcggccggtccagaagctgtgcatgtactccctggataaatacatagggaatatgatagctgtcgagcatctcatacagattcacatgccggcagaaaatctggctcttgctcggctcaatgatgagtccgtcaatatccttctgcagcagttcctcgagacacttcgcctcaaggcttctcgagttgcgcgtattttttaggagaatactgtaaccgttctccgtgagcacctggtcaattccctgcacaatgcgcggaaaaatgtaatccgaaagataagttgtcacaaccgcgatatttttggatggcatcgtgtgccgtaacatctccgagcagaaggttccgcggccgtgttccgcatatatgtatccctcattctgcaaaatctgcagtgccttgcgcaccgtctgccggctgaccccgtactccgccgacagttcattctccgagggaagcttctctcccgggcgtatctcccccgacatgatcttgccgtggagctgctccatcagatcataatattttaatctcttatccattccgtccgatccccctgaatgccttctctctttgcgcgccgtcagcccgttatcccgacagcctccttcgccaggcggtctgcctcctcattgcccatgacgcccgagtgtccctttaccttcacaaaagaaagccggatcttatcctccaccgagcgcacatactcgtagtaggccaccgtaccctttttattgcgcttccagagtccttttgcccacatctcgattcccatataatcgtaatagatcgtaagatcctttaagccaagttcgagcgccttttcgatggctgccatgctcccgaaaacctcgcctgccacattgcgcatcgacgccatctccggctccttccccgcaccctgcagcacttcttttccgccggcatgaatcaaaaaacctccataaccgtacacgccggtaccggcgtgaaaagagccatccacgaacgcgtaattctccggcagatcctctgtctctccggcagattccgcacctctcgtctctgccttgccgtctccggctgttcctgatttctgctgtgctgctccttgcgttgcattctgctgcgccgctccttttgcatgagcttctcccccacgcgccggtgcgctttccagaaacgtctccgcttcttccagcgtcttaaaactcttgtaaaccgctccgtggaacccgtgcaccatcgccttacactcgtcccattttgtgtatattcccggtttcttaccaaccgctaccgcataatattttactgccatctcgtcatcctttatttcgatattttataatacaatataccatataattcccgcacataaaaggtcggaaggtagagaaaaaatgtccggctcggtgtgctgtagcttgtaatgccaagtctctttgccgtctgattcgcccggtactcatggaattcactggttataatcgtgatgggtccgtcgattccgtgctgttgtaacaattccatggaatattgcagattttccgccgtcgtcgtggaccggtcctccagaagcagtctcgccccgtcgatcccccgcccggtcaggtaacggtacatgcactctgcctcgctgatctcctctccatctccctgtccgccggataatacgcacacagcttttggattccggttcagatactcatacgccgcgcaaagccgttcattcaacacccggctcggccgctcccccttgacgctgcatcctaagaccaccgccgtcgtattctccggcgcacggtttgccgcgcttcttatcatccccgccgtctccactgtcacgataagcagaataaaaaggagcaccatgcccagggcggacaatcccgctctgccaccgcgcgtctgccaaagtctccctgccacatcctgtacctgccggtaaaaaataccgtacagcagcacaagggctgacaccgccattcccgtaatgttaccgatattaaccacgacaaatgccggaatgaaaaaccacaggaaaaatacggctccaactgccattatccaccaatgcatccgtgccatcttacctccctcaaaaagcaatgagcggcacgccgaagcgggccgctcttgtcctctcttgttacaaatcttgttacgaaatctccagcttacagttcgcacgcatttttaacggacattcataaacgttctcattattctcttttgcaatgtaagaaagcggacactttctgcagtcgcctttattaaaatctccgccaacctcaaattttaaggttgccgtcttcacacccttcaccatctcttcctgccggatgtgatcccagctcaatacctggctgcaaccggcacacttgctctcgttcaatgtcaccacgcgcttgcaggtcggacaggcataaaacttcttaccggacggctccaccagttccacaacttccgccggaaactgcttaatcaattcctctctcaaattgtcctgcatgatccaatcgctcctttatcctgagtttgcactggtactatcataccacaaaggcggcggtactgtaaaccgctttccttcgttttccgctcagattccgtttcattattctccgggttccgctacttttccccctgttgctgccggatcatgtccatgatgtaatcgatcgtttcctgccactgctccctgtccgtaatcccggcctcgccgtctcccttctgcgatccgtaattgccgaacccggcatggttgccgccctctaagacatactcgcggcagtccgccgcaagaccgattgcttcctgatatttttccatattcaaaacgccgtcctcgctcccgtagagcgagagcaccggaagcgtctgaagtttcctggtcgggtacgccgccagaaaaataagtcccgcgagctctgactcatgctttgccgcatagctgcccgccatggctccgcccagagaatgtcccgccagataccagcgctttacctctccaaactcctgccgcacctcatccgccgcattcggctttaaaatggcaaggtgcgccggcatctttaccgtcacgcaaaagattccctgctgcgcaagcccatccataaccggtgcgtacgccgtctcttccaccttggctcccggataaaagatcagtcccgtctcactctgcggatctccgtaagcgatgtaggcatccgtctccgatacctctgttgtctgaagttcatagtccttcgcatgataataatctgccgtataggtattaaatcccacaatcacggctgccacgattaaaaccgtaaaaataattctgcgcaccgcttttgcatgcttcattgtctctcatcctccgacaccggaatctgcttccgttactttcggatatctgcaaccacctcatccggaatgacgaactgtacgcatcccatatacatcggtgccacatcaccctcgttaaagcatatcacaagatggccgtccgaatccagataaaatgaagtctcatccgtaattttgtcaaaattccattccggaacctcggcattatccacccagtacatcttaccgtcatcctccgccatctgctgctgcatctgctccttgatattctcgctgatcggggtgatataatccgcgccactctggaataaatccgaaagtgtcagacgctcccccgtctttaagtcaatcgtataataatagtcccactccgcgccgctgcctgccgcctgatagcacatcagctttaacgtaaagtaatcgtcggtcgtgctgataacttcgtgcttgaccacgacctcctgatagccctcttcttccttcctgctctcctcgaactccgatacgatctgatccgtaatcttttcaatctccgcattgatctctgccgttgtcttttttaagttctcctgcacctggacctcagtgtccgtcatctgttccgtatcgctctcctttaccgtcagctccggcgtcttaatgtccgccgcatgacctccgttgtcgtactgataatcccggaacgtcacagcctccacgagttttccgaccaccggtagattccccatggcatacgccacgctccccgaggtgttcggcagcaccacgaagactgccgccactgcagcagccgctgccacaatatttctcacggtatgcatttttctgctctcgtttcgtttttccatctttgcttcctcgatccgttttttcatctgctccacctgctcgccggacatttccgatccggcatactgtcgctttaattcctcgatctttttacaatcctgtttcttatttcccatatgcggcaccatcctttcctctattcccactgccatgtatccgtaagttccagccgtagcttctttaatccgcggtacagccggctctttaccgtattctggttctcccccagcacgcgcgcaatatcctccagcttcatgtcctcaaaatagcgcagttcaatgaccgctttatcccgttcttccatggcgtccaatgcccttcttagatcaatgttctcatagcggtcttctcttccctcttccgccggcatctcatccagggaaacttcccggttcttttttacatatccgaagatctcgtttaacataatgcggtaaatccatgtctgcgcatattcctcctgctttagcgcatcgctgtttttgatcgccttgtacgctccgttctgtacgatatccgcggcatccgcctcatgatgtacgtaactgtaggcaagacgatagtatttgttgtaattttccagcaaaagctgttctatcttttgttccttatggtttttcccggagaaaaacatacgatctcacacctccttttaactattagaccgtccggacaccaaaaaagtttcgctgccgtataaaaaattatattttctccgatccggttccgttttttccactctcctgtctgcacagttccgtcaaaaaccggtacattccctcctggtaaatcgggcgctccaccacacaatccactcctgcggcaagcatctgacactccaccagttccttctcattggtcgaacagcagatcgtaaggcttcccttcggaaaattttcccgcaccgaccggataaacggctcaccgccctgcatataccagttcacaaaacacagatcataggcgttgcccttagacgcggctctccttaaatacgccacggcgtccgccccgttttgcaccacgtcaaccggaagcccgagacgcgcaagaaccgctgcatgataatctctcgacagttcattgtcgtccagaagaagcgtctttaaccccgcaaaacttttaggctgtccgatcgcttttccgattccgaaaggcaggaacaccctgcagagaatctgcgcatcctcctgtacttccacacacatcgttccgtgcaaaagttctacgaggctcttgatcagcggatagtcttctcctccgtcaatgctgccctgcacggcaagttccagttcaagctcatcctcccccgttcttacttcccgatagcctgtaaaaatccggcatcccggccgcgcgttgatatacgctttctttagcagtcttgcccagatctgcttgagcctcctgacatcgcccaccagatattcgcagaaaatctcaccctcctgcaccgtcacctcaatccccatttccgtacagattgtcctgcactctgaggtcagttccgcaaccacatccgaaatctgaaaggtgtcgcagacactctcgcccgcacctacaatctgcccgtccaaaacactgtccgtcagttcccggatgtgctccagatgcctgtacatatcctccagtcccacagacttattttccgttctctgacctgtcatttctctgtaacactcctcgattaccgcgacgtccgtgcgcaccgtccgcgccacctgaaacagcagatgttctctgaccgtgcttaaatgccgctggctctcaagccgctccgccagtgtctcatagcgtgtcatgatattgaacacccgcttttttaccacctccggctcgcagggagaaaatataaaatcgtccgcccccatctctaacatttcaagttctctctcctcaccgatgaccgtcttcacgatgaccgggatatcgagaagcttcggatctgccttcatctgctttaatacctgcttcccgctctttacgggcatacacatatccagtatgacaatatccactttccgctcttctaaaatttttagtgtctcatttccgttcccggcttccagcacctcatattcctcttcaaacattgcgcgaaacgacgctctgtttacgtcgatatcatccgctaccagcatcactctgttcttttgcattgattcggctccattcttttatcgtatcggtaacatatcttttaaaatataacataccatcttttatttctcagcaaaatccgtaccgttttttaacatccagcgcccctgtccttcctcttctacaaaattcgacacaaaaagggactggtgcttgaagcaccagcccctttttcttctcaacggtaaatcatactgtcgaggacggcatacatctgtgtaatctcaatcggcttgcttaagtgtgcatccatcccggcatcgagggactttcgcacgtcctcctcaaacacattggctgtcatcgccacgatcggaaccgttttgccatcctcacgtccggattcccggatctttctggtcgccgtcagtccgtccatgaccggcatccggatatccatcaggatgacgtcgtaatatccgggctcatgggaaagaaaatgcgtcacgccctcctctccgttgaccgccacatccacctgcagattcttgtgcagcaggatattgcgcgtgatctcaatgttgacctcattgtcctcgaccagcagcgctcttttgccggtaaaatcgtagtcgggcgcctgtacatcgccctgtccccgcagcttttctccggaatttctgacacgctttaagttcacattcacaatgaacgtcgagcccttgcccttttcgctgtatgcgtcaatgtgcccgcccataaattcaataatgttgcgcgcaatgggaaggccaagaccggtaccgccgtttagcgtcgtgattccttcatcctcctgctcaaacggctcaaacatatgcggaataaacgcttcgtccattccgactcccgtatcccggatctcaaaccggaagccggcatcctccccgtcatcgccggtatgctccacaataaagtcaacctttccgtccggcatcgtgtattttacggcattctccagaatattggaaagcgcccgctccagcttctccgcgtcaaagcaataggtagcatcaaagcttccgcgtctgtccaccgcaaagtgaacgcgacgctccgccgcctgccgcatcgcctcttccaccgtctcctccaaaaaggcatctaagaccaccttctggctgttcaatgcgacgttgccgctctcgatctgggaaagatttaaaatatcatccacaaaagacagcataaaacgggctgactggctgatcttgtccagattctcgagcacctgcttctcattgttcacatattccctggtcagatacgtaagacctatgatggaattcatcggcgtccggatctcgtgactcatgcgctccaaaaattcattcttctcctgattggcatgtcttgcgtcaaacagcgccgacatcagtctctcctgctgccgctgttcttcctcatagctctccgtcacgtcccggcgcaccaaaaccaccgtgtcacggtcatcctgctgataagaaatatgcagttcttttctgcggtatacctccccgcacagcaggcggtacgaaacaaccagatcatccctctgttccagttccgagagaatatgcggcagttctaacgcagccgcgcatgcctcccggtccttgggatgaacatacagcggtatcatctgcgcatttacctgtgtataatctccctccggcggcggagtcacatccgtatcgtcattggtcacgatcacatgaaatgttccggtatgtacatccacataggtaataaaatcgagttccgacttgatgacctgctccagtattccgcgctctttgatggatttcgcgtctcccattctgcatactcctttatttcaaaaaaacaaactatgctttattataacaggatttgaaaaactttccactgcaatttttcatttttccccctgaaagtgcagttctacctacggttcgggcatgtgtccctcctgctgcaatgtgcgcagattctgccgccatgtgccgtctccccgcacgcctccgccggcgcaagctccatctcaaacaccacgcttttcttcggtttcaggcaataccctgccgtacagacgaccttgtgctgttttgcccgcgctaagatctccggcatcgcagacagcggatgtgcttcgtcatcaccgaaaaaatgatatgccgccacctgatacccggtattctcccgtatccatgcctccagcatgccatagcctaacatcagaagttctccgccgatactctcaagcatatagctttccagcatgcgtccggtgttctggtagcgttcctgcagcaggtccacatcgcttccaagcgtcacaaccgcagtcgcccggcgtaccgtatccgtcccatcctcaaacatcagatacgccgcttccttccatttcaggcagcccgccagatcggatgccacacccttcaaaagcgccttatctttttcctcaaaatgataccggctcctgacctgttctaaaaacacacttgtcagacaggtccagagccggctctctatgtatcttcgttccacactgcgctccctttcctgctcttattgtactgcattacagagtcggtgttgtgctagtaaagccgttttcgcagtcccttcgggtaatgattcttcatgattccgcccgcgagctttccccagccggtactgtatccgtccaccgtgattaaataccagcccttttctccctgcgccgggaacgtctccccgtttaggtatccacggatctcccgcccgtccgaaggaagatccatcgtatgtaaaacatccgccgcatgaagtgtgagcgcaagtgcgtgtgaaggctcaaatctgcctttcttcgccgttcccagatgcagtcccgggcgcagcaccttaagaccttttaccgacggcatgccctccgggatccggtagagctgctcgccgaatttcagatagcggcactcccgtcctgcatacttctccaatgcgtccccggcgaaagtctccccggcaaatgccagatattccgggatgcccgccgcagcgctcttagaatctcctgccgcaagtccgttctcatacccgttctttaacagacccgatccgccgtccgcaagcgttccctccttgcgcagcaccgccacataatgtccttccccgcgaagcttatgcggccacagacggatcgtcgcggaaagttctcccagtccgtgcgacattccctccgcaagcggcacctcctccacgtagaattccggatgtctctccaggaatcgcccgatacttccctcgtcttccgccggtgcaaatgtgcaggtcgaatagaccagtctcccgccgcccgcaagcatggatgccgcgcagtctaagatctcatcctgtctgtcggcacacagttctacattctgtgtgctccactgctcacacgcctcctcgttcttccggaacatcccctcgccggaacacggtgcgtccaccatgattctggtaaaatactcactgaaatgttctgcgaggcgctgcggcgtctcattcgtcaccaccgcattggcaattcccatgcgctcgatattctccgagagaatctttgccctcgccggatggatctcattgctgatgaggattcccctgcctgccatcgccgccgcaatctgcgtgctttttcctcccggtgccgcgcacaaatcaagaatccgctcgcccgcaccgtctgccatctgctgcgtcagatacgctgccggagccatggcgctcggctcctggatataatatacgccggcttcgtgatacggatgttttcccggcgtatcctgcgccgtgtaatagtagccatgctctgcccacggtacacgctccagcgagaataccatgcggtttaaaaatgacgcgtcgtcccccttctgcggattcaagcgcagcgcctggtagcgcgctatatcatagctttttaaaaatgcaggatactcctcccccagcatgttctccatccgttccaaaaattcctgtggcagcatctttctctcctttgtctctgcatgattctctgccgcctattgtagcacgaaccgtcccccccggcaacgcattttaaatgcatgcccctgaacaatacttactgcatttaaaaatggcgcgtgagaagatcacttttttccagaaaatcctccacggtggaaaatcccagcttttcaagcaattcgattacataagggttctccagaggtgtctgatacaatgcctcttttccgtaatgatccacgtaggcactgccctcttcgcgcggcagcagcgcccgcggtcctccgacacagcctccgacgcatcccattccctcaaaaaaattagcctccgtcttcccctcctggattgcctcaatcatctgcttacacgcctttccgccatccgcctgcatggggcggaccgcaattttccgtcccgggtgaagttgttctaccgtccgcacgaccgcctcgctgacgcctccggtccgcgcatagattctgcctgctcccgaagaatgttcgcttgcatcctcctccatctgctgcggcgcaatccccattgcctcaaacagcatcgccgtctcctgaaaggtcagcaccacatcaatcgcatcgcagatatccggctccttcgcctcctttttcttggcaaggcacggaccgataaacacggtgacggcatccggatgcatctttttcaccgccctgcccgcagcgatcatcggagacaccgcccccggcatatacggtaccagttccccgtaaatattgcggatcatggacacccagaccggacagcagcagctcgtaagcaaaaaatccgtatcccggttcacatggcggtcaaattcaagcgcttccttcaaggttaaaatgtcggcaaataccgccacctccaccatcccggaaaatcccgcgcgtttcaatgccgcacggattgctcccggggagaccccctctccaaactgtcccataaatgccggcgcaatcagcgcatatacctgtttttccggtgtaagcagcacttcgcgcaccgcatttaaatccgcgaacttttccggaaagaccgtctcacagaccggaattgtgcgctccgtcttttcttctcccgccaaaagcagacagtccatctgatcatatcgcatttcttctttcctctgtttctccgctttgtgctctctttttaatatttcctcatgcaatctgcgtatgctctccatctttcacacctgccttttctttcaaggatgcccatacatcctcctttttattcttcgcacacttttccggttgtagtttgatgcacaaaagaaaaagccatccgttcctgccggatgacttcctcttttgccccgggagccaaaactcccgtttcttctaatcatacagaccgatgtgatacttgaacttgcggtatactttccatccaaagattaccggcatagccagcaccagatatgcagtcgataacattccggctgctccaccaacgatcatcagaatccatattaaaatattcatagtttttatcctctcataaaataataattgctattttatggaggatacaaggccgttcttttttccgtcggccctccttatgtatgctacaatccttcttcccgagggaatcagttcccactgctgcccgcgctctctccccgccaaaagaaacagcgcgcccaaaagtcccgccagaccacattccagaagccacactaggagccgaagctgctggacattccggtagcggtaggcactcttctgcctcagcgtctctatgacatgcgcctcactcagttccctgcctgcggcttccacttccgggcgctcctcgttcggtgacgcgaccatggtgccggtctgcttacggtccggacaaaattcctgtccaccggtctgccccatccgcttcacactgtccaaaggtccggactcccgcactccgtttggcagtgccgccgccacaagcatcgcggctatgagcaaaaggcagagatggcatttaaagaattcccctgatcggattgatttcctttgcctttgcaaaaatctcatcatttttactctccagatactgctccagtccgcggacttcttcgtccgtaaagccctcattcttcgtcacgcggcatgccggcaatatggcttccgcgacatcccttccccgctcaaaacgcacagacacacagcgtctgccgtcttttgcaaagatacccgaatgtgtcagtctgacttcttcttcccttctcattccaatctccattccggaacaaaattactgctgttcctccaaagatccgtcaagcacctggcttggcatctgatcccgcagatagacctttccatggtcttttctgctgtcgtactctgcctgcagctgccggttcttctcctttacttcctgctcaaactctctcgccgagagcaggatgcatccggctccgcggataataatctgctccagcccgtcggaagtggcaaccgtcacgcggtatctcgacgcgtgttcatgggcgaaacgctcaatatacgcgtccgccgtctccgcctccttcgtgtacaccacatgaatattgtgataatcacacgcttccgtctgatgtccctcgacacggtacgcatcgaataccacaatcagctcacatctgcggattccctgatagttgcagagaatatccaaaagccgcccgcgcgcgctatccatattcactctggcaagttccgcaagttcctgccacgcaaaaatcacattatagccgtccaccagcagatattccacgccggcatccttctgcttcccgcctccggaagcagaagcgggactgctttctatgatgcgcttctttttatagccgttcgttgcgccggcatctttgtctctcttattagcattgtatgtccggtcaaggattctgtcaatctcttccgtgccgatccaggcttcttcctcccccgtctttgcgtggaaattcgccgcatccggcagccactgtccgggataccattcctccccgttcttatcctgcccgagcaccggcggcaggtgcatataggaaaacacctgatcccacggcacaatgaatcctgctccgtgcgcacagaatacagaatccgccgtattctccagatcactctgggcatcatacccgatctgcgccaccacttcctccgtgttgtgacagggaaaatatccctttaaggcaaccgaaagcttcccctctcccgcggtgtatgccatcacctcacgctggtaattctgcatggcggacacgggcgcacttcccacaatgcagccgtctgcactgtaggcaatcgttcccttcatgcggtcgatatcattcatggcgcgtccgaccgctcctgccggaagcgagagtctgaaatcataccacggctccagcagcaccgtttccgcctgcatcagtccctgacgcagcgcacgataggttgcctgcctgaaatcaccgccctccgtgtgctttgtgtgcgcgcgtccggcaacgagcgtgatcttcatatccgcaagcgccgatcctgtcagcacaccgacgtgttccttctctcttagatgggtgagcaccagccgctgccagttgcggtcgagcacatcttcgctgcagtccgtctcaaatacgagcccgcttcccggctctcccggttcaagcaaaagatgcacctcggcgtaatggcggagcggttcaaaatgtcccacgccctccaccgtacctgcaatggtctccttgtatacaatccttccggcgccaaatgtgacctgcactccgtagcgctgacggatcagttcgctcaaaacctcgatctgtacttcccccatcacctgcacctggatctcttttaaggtctcatcccacacaatgtgaagctgcggttcctcctcctcaagttcccgcagtctgggaagcatgactgccgggcttacctcttccggcagtatgatctgataagtcagtaccggctctaacaccggcagcctggacgctttctctgcgccaagtccctcccccgggaatgtgtgaagcagacccgtgaccgcacagatgcctccggcgccaacttcctctgccgtctcatatttttcgccggaataaatgcggatctggttgatcttctcctccccgatgacctgtctgacttttaagcttccaccggtcacttttaagtaggtcaggcggtttccctgcgcatcccgtgcaatcttaaatacccgcgcgccgaatgtctccccgcaggccgggatactggcataccggataaagtccgccagaaactccttcaccccctgcatcttgagcgcagatccgaaatagcacggaaacagcttacgttcccggatcagctttctgatctgctccgttccgaccgcttcccctgccagatactgctctaagacctgctcatcgcacaccgccacattttccgcaaaagccgcgctctcctgatccgaaaaatccacgcagttctcatgcagttcctttttcaattccaggagcagcgcctcctgatccgttcccggctggtccatcttgttcacgaacaaaaacaccggcacctcatacttcgccagaagcccaaacagcgtcctcgtatgcgcctgcacaccgtccgccccgctgatgacaagaatcgcataatccaacacctgaagcgtccgctccatctccgccgaaaaatccacatgccccggcgtatctaaaagcgtgaccgtctcctccggcagctttaataccgcctgcttggaaaaaatggtgattcctctctccttctcaagcgcaaaggtatccagaaacgcatccttgttgtccacacggcccgccctgcggatcattccgctctcatagagcagtgcctccgataaagttgtcttcccggcatctacatgtgccagaactgctgctgcaatattcgctttgtcactcacgttctccggttccttttcctacaaactgattcttctgtaacggttgatgcatgcaaaaatctcctgtgccctcggcattgccagcccgcacggcacatagctgctctccgtcaccgcggcaagtccgtgctcctccacatactgcatcaatagggaaacgctctcccttaaggtgcgttttccgttgaatacatggatctcggcatactttaaaaagtaggcgagcgccgcgagctgttccgtatccgccagctgctccacatagcgcacatcgatcgtatcgcggttgatggagatgccgtcgcgtcccattgtctttaacttcatgcgggcatcttccttgaatgcgcgatccggccgcaccgcacgctcaaacgtcggagccgcctgtttcggcggcttcacctccggcagcgggaatctgtccgcttcctccttcgcaaaagcggtgatctcctgcggtttgtagcggttcatctggacaatgcagtccgccacatgaaaataggagccggaacttcccgccactagaatcgtggagataccgtactgctcatacagctccctgatacggtcgataaacggcgtgatcggctcatcctcgcggtttaccaccctctgcatcagctcgtcgcggatcataaaattggttgcactcgtatcctcatcgatgaggaacgtctctgctcccgcctccatggcctccaccacattggcagcctgggaggtgcttccgctcgcatcctccgtgcgaaaggcactcgtatcctttccgttcggaagatcgttgatgaacatggaaatatccacctttttgatgcttcttccgtcctccgcgcggatcttcatcgccgtatcatcggtaatgacatactccctgccgtccccggcaatatggttgtacacgccaagctccagcgccttaagcagcgtggatttgccgtggtatccgccgccgacgatgagtgtgattcctttctttattcccatgccctgtatctttcccgcatgcggcagcgcaaagcttaccttcatggattccggcgccgtaaacttcacggcgtccttcatcggtctgccggacacgccggattcacgcggcaggatggatgcatccgccacgaatgccaccagcccctgctcctttaaatgatcccggatatactgctgatcctccgcgagatccgccgcacggtacaccgccttttcatccagcgccttataaaacaggctgtgtgatacacattccggaagaaacgtaaagaagattttctccagttctcttgcattgacggttctcccgttggcagggaatcccacctcaaagcgaagcaccagatccccctttgcctcatccatctggcatgcggtgcgctccaacacttcctgtcccgggcggctcaccgccagaagtccgctctttccggagccttttgccttgaaagacacgcgctcaagttcctgcccgaactgacgcagcagatagtcgcacactgccagcctgcggcatttcatccggtagagatccgccgggaacttcgctgcccctcccctgacatggacgctcaccttcgacggtgcggcaaacggatctccctgcacatggtcgatcgacaacacataattgccgaaatcgtagcttcctctcgtatccttgtaagccggataactcttatgatcaattctctgtaacagatttctaagttcattctgtgactgcatctttttattccttcttatattccttttatattctttcctgcgaaatcgtcagttgtcccgacgcagctccgacaacagctccgctcgtctcgttccaattaaaagctgtttgttgtatgtcagatagcgctcgcaggtatgctcggagagaaaccttgcggactccgacgtaatcgtgagctccgtgacaaacaccaccatctcctcaccgttctcgaacgcctgctccataaagtcaaacgcgtgctccaacgccgcgcccgctgcttcctcggtctgcaccagtacctcccgctgccggtcaaatcccacttttgccgcttcaaaacagcgctgtgccgaatcttttgtcacttcctgctgcgctgcttttaatttttccatcaaaagcttctcccgctttgcctcctcgcgggtgtaagcgtcatttgcaatctgccgcagcatctcctgctcccgctctgcgacaagcgtccggtaacattccgccggatctgcggctgtctccacctgtctgcggtactcttttaaaaaggcataccacgcatccgtcaatgcccgctcagacgctgccctgccgaaaaacaccgccagaccgtccagcagcagatgtaccaccgagagccgctcatcaaacgccgccgcatagatgcgcgcgtagatctccggtctgacgcagccgtccagaatctgcggaatgccgtagtcatcctgatatttgcggtagagatccagatacgccgccacatcctccgccacatcggcgtgatggatatattcccggataacctgctcgtccaccagaaaaccgagcttctcatagaccgccatcagattggagagatcctcccatcctcgcgccgtcacaaactgcatgccgtccacatccgcctccacgcggtaaaagttgccggggcgaagttccaggtagcttaagatcgctccgctgatgtgctgtgccctcgcatactccttccagaccctgtaatccgcctccacggtcatatagcgcacacggtcgagggttaccatatcaaaatcgcgcacggatttgttgtactccggcggattgcccgccgccacaatcacccatccctctggtatcttctggttgccgaaggtcttgcactgtaaaaactgcagcatcgtcggcgcaagcgtctcagacacacagttgatctcatcgataaacaggattccctcccgctgcccgctgtcacgaatcctgcggtatacactggcgatgatctcactcatcgtgtactccgtcacagagtaggtcttccccgcgaattcctcctcccggatgaacggcagtccgacggcgctctgtcttgtgtggtgcgtgatcgtgtatgccaccagcccgaccccgagttctctggcgatctgctccatgatctgtgtcttgccgatgcccggaggtcccatcagaagcaccggtctctgccggatctccggaatctcataatcccccgcctcatccttctttaagtatgcctccacggtatgtttgatctcattttttgcctgcctgatattcatatctgtgtccctttttatctcttaaaattcaaaaatgaccgcgggaatactccctgcagccacttcacatgcactgtcttttgccggttccctgcaattataaatattctatgttccgctacaggaaaagtcaataactttacccgcaaaaggtttcgttacctgttgcatttcaaaaacaaatgtggcataatacatattgttcgggcgaaagatttttgatatcgtctgaatcagaatccggggatatagctcagctgggagagcgacgcgttcgcaacgcgtaggtcaggggttcgagtccccctatctccatctttttttatgtttttaaagaaatgtccggcagcagacgctgccggacatttctgtctctcttatcttcaaacgggtctcttgtacggctttgatccgcctacatttccagcacgtcgtccgcaatgcccatcgtggacttccggtgtgacaccatcagaatcgttttgtccgcacattcctctttcaggctgcgcagaatcataccctcgtttaagctgtcaatgttgctggtcggttcatcgaggaacaggatgtctgcatcgtgcagaaaggcgcgcgcaattccgagacgctgccgctctcctcccgacagggagctccccagctccgcgatcttcgtctcataaccgtccggcagactcatgataagatcatggatggacgccgcccgcgccgcccgctccagctcctcctctgtggcatcctcttttgccaccttaaggttctccgccaccgtgtcatggaacaaaaacgtctcctgcgtcacataggagataccgccgcgcagcgccgctgtattgatctctccgatctttgttccgtcgtaggcaatcactccctcatccggctcgtagaaccgcatcagaagcttcaacaaggtcgattttccgcagccgctctttccgagaatgccgtgaatccgcttttccgtaaaatccgccgtaaaatcccgcagcacgtcgcgtccgtcttcttccccgctctcctgcgtgttcgcgtaggcaaaggacacatggtcgcagtgtatattctgaccgcacgtctcctcttttccggtcacttcctccacgagcggtttttcctccaggatatccagcacacggtttccgctcgccaaggtgtggtttaaattatttgacagcgccgagagtgctgctgtcggtccgaaggagcttgcgagcgcgatcaccgcaatcaccgccccgcttcccgggatgctgccgttttctgcaagcgttccacccacgagcgccgcaagcacacccgcaaagagaatcacaccgtcggtgatcacgcgctgtaagttctccccccgctttaatgcgccgttgaccgtctccagatgtccggtctgctccgccatcttagcgatgcgtgcctcctgctgtccgtactgcagcgtctcctcaaggccgtaaaggttgtccagcacacaggtattcaaagcgccgaatgcctcccggtattccttgccgccggcagctccgatccgtccgttgacaaccggaatcacggctccgacaagcacatagaagaaaagtgccagcactccgaaaacgggatgtatccttcctaagaagatcgtcataaccaccgatgtgatgaccgcgattgcgatcggcgagatcgtgtgtgcataaaacacctcgagaagttcgatatcgctggtgataatcgagatcaggttgccctttttcgcgccgtccaacttggccggtgccagtctgcgcagggaatcaaacacctgatgccggatgcgcgctaaaagtttaaacgcgatataatgattgctcgcctgctctgcgtaacgcaggattccgcgcgccaccgcgaagcagaccagcagcgtaaagatcacggaaagcctcattccactgtatacaccggtcacggtaagcagtgcatagcctccgaggattgttaaaaacgtcgccatcagattgcccgcacagcccatcagaatcgccagacacatgatgccaagcagcggctttatcatcccgatcagcccgcacatgacggcaaatccgcttctctgctttttattttgattgtctttgttctgcttcattacaccgtcacctccttctgctgtgtgcccgcataggattccagttcctgctgcgcctcatacagcctgcagtaatatccctgccgctgcatcagctcctgatgcgtgccgtgctctgcgatcccttccgtccccgcctgcagcacgaagatctcatccgccactgtgacattggcaaggcggtgtgagatcagaagcaccgtcttttcacgggcaagcccgcggacgacttccataatccggttctcactctccacgtcaatgttggatgtcgcctcgtcaaaaatatagatatcgctgtcatgcagcagcgcccgcgccagcaccagacgctgcttctgcccgccggaaaggtttgccgcgcgctcctcaagctgcatggaaagtccgcctttctcccggatcgtctgaagcagatccactctcaaaagcacgtcctccatctctttctgcgtggcatctgcctttcccatccgaaggttgtcctccacggttcccgcaaagagatagctgtcatggcgcactcttgtcaccttccggtaaagtgcctccgccgtaagctctgtgaccggcactccaccgatcgtaacactgccgccctcttttggacggttttcccccatcacaagcgatgcgaccgtactttttccacaacccgattcaccgaccagcgcgacaaaactcccgcccggcacggagaaatccacatcgcgcagcaccggggcatccagtgtgtaagcaaagtccacatgggaaaaacagatctcattgccctgcgttttctgcacagtaccatgctgtggcaccgacgtatccaaaaaccggaaaatcttgtccgcagcggcatttccattcatcgcaatatgaaagaaggagccgagcagacgcagcggaaggaaaaactccgccgagatcataatgataaaaaagcactccgcaaacgtgaccgctcccgcccggtattcaagcacgcttaagatgatgccgagcgccgctccgccgtaggcaaccagatccatcacgctgatcgaattcaactgcatgatcagtacacgcatggtcactttgcggaacttttccgcctcctcatccatcttcttcgcatagcgcccgtccgcctgataaatctttaacgtgacaagtccctgcagattttccagaaaggaatcgccgagttccgtgtaggttccccagtattttgccagcagcttcttggcaaacttctgtaccgccacaatcgacaccggaatgagcggtacgcagagcagcagcactgccgccaccttgatactcatggtgccaacaatcacaaacaaggtcagcggcgccagcatgctgtaaaaaaactgcggcacatattttccgaagtagatctcaagctgatccactccctccgtcgcgatctgcaccgcctccgaggtcgccaccgcctcccggtaagccgccccgaactccatcatcttctcatagatccggtcgcgcagtctgcgcttcacctgcgtggacgcaagataggacatccggtttgccgcactcgtcgccgcgatccgcacaaaaagcgccgccgcaaatacgataagcagcactccgtcggacggggaggtcgtgaggctctccccttttacaattccggatattctcccgacatacgctgccagcacatacataagcgccacattggcaagaagcgccgcccactgcatgataaccattcccgccacgtatttccggttatcggaaaattcctttaacagtcttttatgaaacatgtttctctcccttttcccttgtactgatctctttctgctttttcttattccgaagtgtgatatgcacatgccggatggcaagcagcggatgcacaaacaacatccttggtcccgcatacttcatcacttcacggattttctcctgcatctccttcgaataacagtgcaccttacaggcactgcagaacgtcttcgtctccataaacgggcatttttccgtgcgaagatcggcgtacgcctgcagctggcggcacgcctcgcagagttctccccgcttcgtcccgtgcactccgcggcagtagatgccgatcatgcaatccacggtctctttctcccccgcacgcttctgttctatctcctgcgccgtcattttctccattccctagtcctcacttctctcctttaaaatctgttccattatcccggcgcactttggttcaaaccttgtattttcccgctcctttatcttgcctctcaccatttccgtactctcgccccagcgtagatggcggtccgcatagtccgccaccgcgaggatctgcgcgagcaccggtatctcattgccgcactttcccgccagataaccgctgccatcataattctcccgatgatagtacacggtctccgcgattgtatccgccacctgcagttcgctgatcatatcatagcccatcttcacataagtctggaacacaccgtactcctcatccgtcaggttccgtctctggatcagttcgtctggaatgccgatcattccaatctcgtgcagaagacctgcctgataagccccggacaccatatcctccggaagatccagtctttttgcaatctcttttgcgtattccgccacctgcctgcagtgttcctcctcaccgggaatcttcgcgcccagcgcgcggcacatcgcattcatcacacgcatggacattccccacagcttttccttttcctcgcgcacgcgccgctccagccgttcctgccgtctctgcttctccacccagtaatgctggatggagtacattaacagatatgccatgaacacaaagcacacatacagataaggaaaacgcagtgccacattctccccgtagatatcttccgcggaagcattcaggtcgaaccggaagcacaaaatcatcgccgcaagatagaacagattgatgacaaaactgttgcggattcctaagataaatacaattccgcaggaaaacagcatcgggaacaatacactgaagtacccaatgctcgcgtggtaatacacataaaaaatcggaatgctgagcaacgtgaatgtcaccacatcgatccatctgcggtaatgcctccgacagaccgcaatattgccaaaaagcagcgccaccatgatccccaacgcaatcagataggatgccctgacaccgtaaaatatgccgttcaaaatactgattgcccagataaatccgaaaacaattttcatccagagtgccaattccctgtcctcataaggagcattgaccgtatcccagaagttctctcttattctctttgcttttgtctctgcgttcttcatcctttataccgtaatcctgccttcctcgatcaatgcaacaaccgcctgcgccactccggcgtcaaactgtttcccggctccctttcggaattcgccgataatgtaatccctgtcacagtgctttctgtaacagcgattggaattcatcgcgtctaacgcatccgccgcactgataatgcggaccatctccggaagctcctccccgtgcatgccataaggatagccgcttccgtcgtaccgctcgtgatggtatgtcgcgcccagatccgcctgcggcaaaaactccagaccggataagatctctctgccccagaccgtatgttttttcatcacctcgtactcttcatccgtcagccgttccggcttatttaaaacggcgtccggcaccgcaatcttgccgatgtcatgaagcagaccgctgcggtagatcagttccagttcctcccctgatgcgcagcctccccgcatataatccgcgatcagcctggaatactccgccacacgctgggagtgttctctcgtgtaacggtccttggcatcgatcagctggctgatcgccgtgactgagtgaatcatcagattcttcgtgcccgcaaccgcctcctgcacctcattctccagattttcctcattctggcgctgccggatctgataatttttgtaaaaaatatccatcgccacatccatcaggcagaatccccagtaaaaaatcggatagaacacccgataatccctcggataatcataccttaatatatccgcaagcggcgtccagaaaaaagtcataatcatcagaccaaatccgatgcacaccggcgccccaaatggcattccaagcggaaccagcgtgataaccggcagcagcagataccacagcagggaaaagccgtcattcgcacccgcgtacagaatggcagccgccagcagcaggaacaaaaagaccgcaatccgacacacgagaaccaccttctggaaccgccggattacaaacaccgccgtcacgctcacaattcccacgaccagtgtcacaattccgatgacatactttcccagccggaaattctcaatgtcaatcagaaacaacaccaccgcaaagatcagcatgaccccctgcagtgccccaacatccatgccggttgtcttctcataccggtacactctttttatcgtatctaccgctccccgaaacagcttcatttgtctcccgctccttttatccgccgaattagtttatcctaactattttcttcttgtcaagcatcatttttcatatcccttattctaccaaatcccacttcacatgtacagaggagcgtttttatggggctgccgcaataagcatattacgctttgctctgataagtaatattattagaaacagatatttaaaagttccagataaacatgcggcaacaaattctgaacgcaaaatccggtatttctaaccatgccgcagatgacatctgtgatgatccatgtctttccaagtttggagcactccacggactgtgtccacaagccggcagacaatttgtaggacttttgtgtgtgtcccttatggcacctctgaacaaaacataaccgcgcgaagccgctgtctgagtcggcatctgccatattttcaatagcagatgccggcgagttcggttcgcgcggttttatattgtctgtgaagaggtgccattagggacaccagaaagtccgcccattgtctgtggcttgtcggacacactccgggagtgttcaaacgtggcaaagacacggaatgggatgccaactgcggcatggaagaaatacatgaattttgcttcaaagaatttgccgtcgcatgtttattctggaacttttttgtgctctactattctaataatattacttatcaccccaaagaggtctatgcttatcgcggcagccccataaaaaaactccggcagactcttacgaatccgccggagctactcttttttcagattttacagttctttctcgaagaatgccttcatcgctgcaacagcggcatcctcatccgcgccgtccacgttgacggtcactgtctcgccctgctttacgccaagcgccatcactgccatcactctggtagcgtccacttccttctcacccttcttgatggtgatcttgctggtgaagttctttgcctcttttaccagaagacctgcaggtcttgcgtgaattccaagttcgtcttttacggtgtaatcaaatgttttcatgttttccatttcctttcttttcttaatttatgtggcttttatttactccattccgacaacgcgctcgcgcaccggaagtaccatcgcaggtgatacggacaattcgtcgattcccatcgcaacgaactgttccgtcaatgttgtatctgcgccgagttccccgcagattcctgcccagataccctccttatgcgcactgtcgatgaccatctgaatcatcttaagcactgccggatggtgggaatcatagaacatatcaagctttgcattctgcctgtcgattgccagtgtatactgtgtcagatcgttggttccgatactgaaaaagtccacttcctttgccagttcatcggcaatgatgactgccgccggtgtctcgatcataataccgaactccaccttgccgtaagggatcttctgtgcatcaagttctgcacggatctccgccatgatctccttgaccttctgtacctcccagacggaaataatcatcggcaccatgatggcaatgttgccgaacgcactcgcacggtacagcgcgcgaagctgtgtcttaaaaatctccggacgatccaggcagatgcgcactgcgcggtagccgagcgccgggttatcctctttgtccagattaaagtagtcgatctttttatctgcaccaatgtccaacgtacggatgataacttttctgccacccatcatctccgcaacgctcttgtatgcggaaaactgctcctcctccgtcggataatggtcattctgcagatataagaattcactgcggaacagaccgattccctccgcatcgttcattaacgccgcgccaacgtcgccgatgccgccgatattcgcgtacagcttaatggatttgccggattttgttgcggtcggcttgcccttcaatgccgataacagttctttgcgtttgctctcgtcttctttcttcttctgatactccgccaggacgctctcctccggctcaatgatgattttgcctgccatgccgtccacaatcgccattttgccgtccatgccgtccgctaccggcgtacataccagtgcaggaatgttcattgtgcgggcaaggattgcggtgtgggaattcgtcgatccttctctcgtcacaaacgccagcaccttggaacggtcaagctggatcgtctcactcggtgccagatcgtccgccagaatgatcgcctgctccatctccatggactgcgcgccgctgccgtgatgcaacacggcgatcaggcgctcggaaatatccttgacatccgccgaacgcgccttcatgtactcgtcatccatgccggcgaacatcgctgcaaaattgtcccctgtcgtagcaacggcaaactctgcattgacctcctgtgtcgtgataatgttgcggatggaatcgcagtaatcctcatcgtccagcatcatctgatgtacctcgaagatcgctgcattgtcctctccgacttcctttaccgctttgtcatagagtgctcccagctcctccatcgcgactttttttgcctcctcaaagcgtatacactcagctgcggtatcatcaacatgtgatcttctcaccgcgctgctcttcttggcaaactcccggatcgggccgattgcgattccgctaaaagcggtttttccctcgatacaaatcatatgcattctcctttcattcttcgcttattcatctaatccacgcagtgtggtctctacctgttccagtatgtgtgcggcatttcccgcggcatagtcccccggcgcaatggcaagcaccggcagatttccgcactccgccgcaatcttttccctgcggtatgcaatctgcggtcccagaaggatcacatcataccccgtgcagcattccctgtaggcatgtaccccgacggcctttacttccagcggaatctgttccttttttgcatattttatcagttccccgcgcagaatgtcggtcgacattcccgcgctgcagacaagtaatatcttcatcggctgcctccttttgcctcctcaagcgcacggtagacatccacgatctcctccgccatttcctgcgccagcgtcgccatcatgaaatggtcctgcgcgtgtgtcatcagcagtcctgcgtctgtctgctgtccgcccgcctcccgtaccagaagatcggtgtgcaccttatgtgcttccgtggcatagcgttccgcctcgtccaactgctccgcggctcccgcaaaatcaaagtccttagctctatgaatcgctgcgaatgcacagcttttcgccgcacctgccttcgcaatgatctccatcgctgcttctctttgctgttctgtctcatcgatttcatccatcctgctcacctccgtgaccgactctgtctcattcctgaatctgcatcagtatggaaatgatgttcgccatctcgtcatcggaaaaaatcatgtggaatttccgctcgaccggcgctacatattttcgcagatcccggtataccccgtgatacttctgcacaatttcctcgcggtgcggattctctatggaaacgccccttcccgcaatccggttgactgcgcaggcaatgtgcatcacaagtcctgtcttggtatctaacgacatcggatattttccctcaatctgctccgccagttccatgagcgcctcctttaagcggccgatgtccacatattccagatgatcgcccagacagcggaacatttcatcaaaatcaacctccgccttttccatgcgctgtgtgcgcaaaagctccggcagacgctccaccggcaccgccagcacatccgccgctgacagaaacggaatcgccagaatgtccggatcatacgttccgataatacacaggatcactgctccctgcataagttccagcagtttttcccgcagcaggttccggtccgataaggataaggcaatcacctccgcgtccgtgcaggctttatgctggatgagatactgcttcatctgcagcgcaacaccctcacttgtggtgcagagcgtaacgattactttttttggggaatgccgcagcgccccgagcgactctgccgccatccggtaaacccggtccaccccatcggcgattgccgcccccttcgaccactccattccgaatcttgtgaccggaagcgctaccgcgcggagctgtgttcctgtctcgcaggaaattgtatacaacatctgctgcaataccttctggtcatacacggcaaggactcccgcccctctatcgatcgcgagcagtttttgccgcagcaactcgtaggtctgttcatccttctgttcgtaaggaatgtcaacggcatacacgtttccgcggtgaagctgctcctcgatggtatctgagagtgcccgcgcgactccctgtccgtaaaagacaaataaaagtaccggcgacggttcgtccgtccggatctgtggctcgctgacctgcgtctcctcggcaggcggcatttccggtgcaagtaccgtcacgcccccttcctgatagaaatagcgcatctgcggttttaccagcgcatccaccgcctccttgtccgcgcggtagtttaagaatcccttgcgcacagacggatcaaagtcgctgatgtagaggtgaagttctcccccgtgatccatgtagtcccgcagataagcattcatgcaggctttccggatctgtgtctttaaggtcagtatctccttttcacaagggaacagcatcaggcaggtgagcacctcggactccagcgtgatcgtgcgcttcgttctgcatgcctccgccaccagaaaatgttccagcagcttccgccgctctggaagcggacgctccgtaagggacgggagccggatctccgccagcacgtggtcttccagcatggaaatcacatccagcgccttgtcgtcgcaggatagaaaaatcatcggcagttcccgcgcatcctccgcctccacaaaacagcggagcagcttacgtctgacgttcaccgacaggaactgtaccttatgtaaaaacaggattcccgtggctgcctccgcgagcattcctccctgcacgccgtctccgagcagttctgcgatcgttgccgtatcgtccgctccgaaatccatgcagtcacacattacaaacggcgcctgttccgcaaccagtccctgctgtacggcagctttgtgcatcacttccgccatgtattttctgccgcttccctctcttccgatcagaagaacattcagtccgcggtgcggatacaaaagtgccgccctggcaagctgaacggcgtattttaaactgccgtcatatcccaccagttcccggaacgctccctcctcatccgcaaacgcttccgtcagcgaatataagaccggccggctgctgctcttttttaccctgtcttcccggaggagttcgcccagtgcagtgctgacgttggtgcgctgcattccgagtgcctctgcgatctcattagtagagatcccgtgattggcattcacggagctgtggagttttacaaattcgtatatctgctctctgtttcccttcatatggttcctcataagaaatcgctgatctcttcgatacgcttactatatgttttttctttctgactgtcaatttcacatagtgtataaattttgtatccttcatctatactcattttcatacaaaatgctttctttttcaactctctttttgtctgttttttccaataatccgcttcttttcttcctgtcgcttctttctccgcttatttagtgtatatgtttctgctgatcatatacacttagtgtacaagttttttctttttttacatttttaaagattttgaaaaaaagaacccgtgagaacatctccgcaattcagatatgttctcacgggttcttatgataatttcaaggttatattttgatgtttcttgaaggaaaaatggcaccgtttctagtacagattgcagcgcccgcgctcctcgcgctccatatcacgcacatactgcgcctgatattccatcgtgatctcacgaagttccttgattccctcaatataaggcagatacatatcatacccgtccatggcatcatcgcatcctaactcactgtatcccagggaatcttttacgatctgctcccgctgttctcttgttgtatttttgatcagatattcttccatgtttttctccttattctaaaaagtcagacgcatttcataccacacagcgcctccgtgttccgatccggataccccctcattccggtagccgaactgcccgtaaaacgaaagcagcctctccttacaggtcagcaccagtccctttttcccctgtgactttgtatccgcaattaccctgcgcatcagcgctgccgcatatccctttccctgctctgcggggtccgtcgccacaccaaagatcatctgccacgcaccatccttgctgtgcatatcggcatgttcatacatcgcgtcggtcagatgctcctcgtcggttgccatgccgttaatcatggataccagtttttcatcctcgtagagcagccagaaatgatcaggaaaacttgccagccgatcgaaaaatgccgctctccccgccgcttccgccgcaggaaagcactttgcttccagctctgtaaccgcctttaagtcctccattgccgcatgtcttatgatcatcttctcttcctccctgcgccgttctcttatcagaacacattataagcgccttcttcgcccagtgcaagtaaagccttttcactttacgtgaaatatccgcaaaaataaggctgtcgcatgtagcagatgttatccctttcagcgataagtgatattacaggaagcacatgatacagatttcggctggaactgcagatggaacattcgttgaaaaaaatgggtgtatttcttccagccggatgactgcatctgattccgtgtttcttccacgtttggacaatccgacgggtgcatgtccgacacacccgagacaatgggcggactttctggcagcactaactgtgctccctcatagacattattaaaccgcgcgaacagaactcgctgctatcagctattgaaattagggcagatagcagctcaaacatctgcttcgcgcggttatgttatattacgggagcacaggtaagtgctgcacaaaagtcctacaaattgtctctggggtgcggacatgcaccctaggattgctccaaacttggaaagacacggatcatcgcagatgcagtcaccggctggttagaaataccgcattttttgaacagaatgttccgtaggtattccaaccgaaatcgtagtggcatacttctcataatatcacttatcgctgaaagccaacgattcctctaatgcgacagccgcatttttgcagaattctatttcacgtaaacgggaaaagtgctttcacagccggatacagcttccggaattcctgatagcgcgcctcatacttctccaccagcaccggatccggctcaacggtgtcaacaacatgcaccagcttctcacatgccgcctgtacactctcatattccccgcagcccactgccgcaaggatcgctccgccatatcccggtccctcctcgctctctatgagatcaagcttaaggtttaaaacagccgcaaggatcttcttccacagcgggctctttgcaccgccgccgcagatcttggagcgttcgatccggatgcccagactgcgcgccacctcgagggaatccctgagaccgaacgctacgccttctaacaccgcctgcgtcatatcttcccgtgtggtgtccatcgacattccaaggaacatggctctcgcatccgggtcgttgtgcggagagcgctcccccatcagataaggcaggaaaaatacccggttttctcccagatttttaatcttttcctgctcccgcgcatactccgtcgtctttaaaatctcatccatccaccacttgttgcaggatgccgccgagagcatacaccccatcagatgataaccgccatccgcgtgatcaaaggaatgcagggcattgtgtgcgtccacaccaaacttttcactggagataaagagcgtgccgctcgttccaagcgacaggttgcatctcccctcaccgaccgtcccggtgccgacggctgccgccgcattatcgcccgctcccgcaatgatctttacttcaggagaaagtcccagttcttccgcgatctctggctttaaggttcccaccacctcatagctctcataaagcttcggaagctgctctctttccacatggcagatctcaagcatctgctccgaccatgcccggtgctccacatcaaggagcagcataccggaggcgtccgaataatcggtgcagaacgttccggacaggcggtatgcgagataatctttcggtagcatgatctttttcacccgtttccacagatctggctcatgcttttgcatccagagaatctttggcgccgtaaatccggcgaaggcaatattcgcggtatatcccgacagtgtttcctttccgatcacctgatttaagtaatcggtctcttctgccgtgcgcccgtcgttccagaggatcgccggacgaatcacttcatcccgctcatccaatgtcaccagaccatgcatctgccccccgaagctgatccccgccacccggcttttatcacattccgccagaagttcttttaagccgtcgatcgactgttcataccagtctgccggattctgttccgaccagcccggatgtggaaatgaaagatcgtaggtgcgcgatgcaattttttttattttaccatcggcatccatcagcagcaattttactgctgatgtgccaagatcaattcctatatataacatactctccccttttcttatcattgcaagacttcgctatgcactgcaagacttcgctatgcactgcaagacttcgctatgcactgcaagacttttctatgcaaacggattctccgtcggatagcgcacgcctgccggctgattgtagccgatctcctccaccggcacaccgatatacttaaatacttcgtacagcgccttgccgtaatgtccgaatgccaccgcgccgtggtgcgggaaattcttctcaatcagcacatggcggtaaaatcttcccatctccgggatggcgaaaacaccgatcgatccaaaagatcttgtcgccaccggaagcacctccccatgtgcgatataagcgcggagctcgcagtctgcggtgctctgcagacggaaaaacgtaatgtcccccggcatgatgtccccctcaagggttccgtttgtcacctcgaccggaaggcttctcgccatgatcttctgattgcgcatctcacagaacgcaagctttccggaagtggtatttccacagtggaatcccataaaggtgtcctttaacgtatatggatattttccctcgatctcttcctcatacatatctgccggcaccgagttattgatgtcaagcagtgtcacggcatcttcgctcaccacggtgccgatgaactcgcttaaacagccgtaaatatccacctcgcaggacaccggaattccctgtccggtcagacggctgttgacgtaacacgggacaaaaccgaactgtgtctggaatgccggccagcacttgcccgcaatcgccacatacttgcggtagcccttgtgatcgcgcacccagtcttttaaggtcagttcatactgcgccagctttgcaagcacttccggctttttattcccggctccaagctccgcctccatctctgccacaaccgccgggattctctcatccccgtcatgtttatggaacgcctcgaataaatcaagctctgaattttcctcaatctccacacccagattgtaaagctgctttatcggtgcgttgcaggcaaggaaatttaacggtcttggtccgaagcttatgatctttaaattggaaagcgcaactaccgcgcgggcgatcggctcaaattcatgaatcatgtccgcacattcctctgccgttccaaccggatactccggaatgtatgccctgatattgcgaagctttaagttatagctggcatttaacattccacagtaagcatcccctctgccatccagcagactgtccccggattcttccgccgcagcaataaacattttcggtccgtcaaaatgctttgccagcagtgtctcggcgatctccggtccaaaattgccgaggtatacgaccagtgcatcacacccggccgccttcacatcctccagtgcctgcaccatatgtatttcgctctccacgatgcagatcggacattcatagatgtgatcctttccgtactttttcgtgtaagcgtccattaacgcctttctccggttcaccgacaggctctccgggaagcagtctctgctgactgccacaactccgatcttaatctccggcatattttctttgttcataaaaatctcctttccgtttcaaaaatagaaaccttcctgctccgttttccctgtatctttcttacacctcaatattgacccccaaaagtccgttaaaagcaccacggattcctgcttcctcatgtgcgatcagccacttgttcttcgcagtcataagcgcatcctctccgcttttgggcaaggcaaaatcaatctccgtattcgtccctttcggaagaatcacaatacatttaaatccttcctccccgtcattgcacggcgcatagtgaagtgtcgttccatacatctcaacaaccgttcccgccgggacaaaaaatgcttccaccctggatgtgtcataagtaaacgcatcggtcacatccggcagccatcctaacagcagcaccatattggttaccgcaatattgatctccgaattgcggtgatactccaacgcatttaatctgtgattgctgccgttacaataaccgatctgaatcggaagtccgccgtagatccgtctggcaaactctcccgcctccggcagcacctccagttcctccatggatggcacataaatgacatcctccggcagcggcgtgtgttccatctcgcggatcagtctcgtgcagtcaaagccgctccagactttcccatacctgcggaacttttcgtctttaattgaataaatctccatgattcccccctgtttgtgctcctttccataagtgtaccttataagcagagtataacaggagacagtcatggagactacctgtttcttgtctttccaatgtcacttttttgtctttttatctaatttatttatcagtgaaataattcttcccgcacagagacggattttcttttccgacagccttccgtctgcatacgcctgccggatatccgcatcatctttctcacttcccggcataatcagatcatttccggcttcgatacacttccatggaatactgccgtcttccggcgctgttgtactccagtccgacatgagtacaccgtcaaatccccactcttctctggcaattacagtgcatagcgctctgctgtttgccgcgtgaactccattgacccggttgtaggatgtcatgattgcaaccggtgcgctttctttgactgcaatctcaaatcccctaagatagatctcccttagggctctctctgaaatatgcacatcgacccccatacggttgtcttcctgattgttgcatgcaaaatgcttgatcacagctccacaggttccctcctcctgtacacctcggacaaccgcagcagccatcttgcctgagagaaatggatcttccgaatagtattcaaaattccgcccgcacagcggatttctctggatattcattcccggtgccagccacagatcaatatggaattctttcatttcatgtgataccgctcttccgaaagactgcagcagttcctcattccaggtctgcgccattgccgttccgaccggaaacgccgtacagaactgatagtaggtcttggcattctcatgcttttgcatcggctccagatagccattttccagtgctcccagtacactttttccatagactttccccgaatctgcgtctacctcatacgactgatgcagccggattcctgccggtccgtccgccatgattaacgcccttattccatagggctgttccagcgcatgtgttgtctctcccgccgatcccgggacacggattcccgccgcgccgagtgtactgctgttttgttccacatggccatataagagcggaatcagttcctctgccggtatttttccggtcagatgcactttttgctcttcagcggcagaaagctttcctgcatcactctctgctgcctccagccggcatgtgtgctctgtgatcgtccgttcgtacacatcaaattcccatgcctgttctaacttttgtgaatcggcaccgatccatatgccatacgttccgtcttccagataccaggcactctgttcttccgaaaaacttgcaagcatgttttttggtattttaatctccagctgctgtatttcccccggcagcagacattttgttttggcgaatcccaccagccgctttttttctttttccattccggtctgcgggaatgtcgcatagacctgcactgtctccttcccggcataggttccacccgtattctgcacagacactgcaagttccagggaattcgtttcctcgcgtacagaccgctggcggattaggaatgatgtgtaggaaagtccgtacccgaacggaaataataccggcagattttcccggtcaaaatgacggtatccaacgaaaatttcctcccggtattcttccttttccagatctccgttcctgtatccataagtatccgctgacggataatccccgtaatgtctcgcccatgttgccgtaagttttccgcttggaaccgcctttccaaacaggatgtccgccaccgcataaccacctgcctgtcccggctgggaaatatttaacacagcccgtatattttttgcctgctctaaaatatctgtcagttctaccggaccaccggtattcagcaggagcactaccggaatctttttctcattcaaaaataacaggtcttcctgttccctgcggcttaattcatagtcgccgcgctcttttctgcggtcacttccctcacctgaaatgcggctcagcacataaactgccacccctgccccggcaatgtcctgttctgtaaccgctcttccctccgggaaacagaacggatgattggaatatgcgtcaaacggattctcaacccgttttgtttcttcgagaaccagttttttccattcctctctcgcctgctcataccgcttttcatagtcgcacagccacgcttcacttgtgatcattgcgcccgcttccagcagtccctgatagacagaaattgtcttccggttgttgacatccccggagccgattccaccttttaccgtcttttttgccccgcttccaaacagcgccataggaacatccaaaggcagcggcagaagcgattcattttttaataaaaccattgcctcttctgccacttttcttgccagaacatcatgcacctgctcccggatggacgttctttcctctatggttccactatatctccattctcttttttccatattctctgcttttcccttcaaaatgacagaaagaaccatacagaattttcttccatatgattctctgtccagatcgtgtttactctttcactccaccaagtgtcacaccggcgataatatattttgataataaaagatatactacaatgatcggcacaatcgccaccgtaatcatcatgtaaacttttcccatgtcaaagttcatatagtctgctccacgcaatgtcgcaattaagatcggcactgtcattttgctcttggtctgaagaatcagtgccggaacaaagtagttattccaggaaccgacaaaagtgaaaatcgcctgtaccgcgagcgccggcttcataatcggcagcacaatacagttaaacgtcctgaattcgcctgagccgtcgattcttgccgcctccactaaggacaggggcagtgatgactgcaggtagctgtacataaaatagaataccgcaggcgacgcgatgcttggaataatgagcggataccaggtatcatacaaccccattttcgtgatcagccgcaaaaatcccattgccgttacctgagtcggcatgaccaaaattgccatgataaaggtaaatgctatctttctggtcttaaattcataagcatacagaccatatgccgtcaacgcggaaaagtaagtacacaaacccgcacaggcagtcgagatacagatactgtttataattccgcgaaacatcgggaagcttccgtcatttgccacattctttaaattttccagcagatgggtgcccggcaatgccgaaaaccccttttgcagctccgcatgagaacgggttgcattgataatcagaatatagaagaagaacagacacataaatgacagtacaatcaacacaatatgcgccagaacactccgcaaactgtttcctgattttgatttcatgttttatctcctccttcttctttcttctctggcagcttttttcgccgctgccttcgatccgtccggatcattatcatttgtcatcttatacacgataaaacataagatcgcactgatgatgaacagataaacagataacgctcctgccataccatagttcttgctctttaaatgattatttaagaacatgatcagtgtcatggatgtccggtccggatttccctgaccgttcgttaagatctgtggcacatcaaacatctgcaatccgccgataatcgaggtaatcagtgtatatgcaagaatcggccggatcatcggaagcgtaatatagaaaaatctctgcagactgttgcacccatcgatctcgcaggcctcaaatacctccacactgattcccatgattgctgccatcagcataatcgtcgtattgccaaaccacatcaggaaattcataagtccaatcagggaacgcgtgccaaaaacagatcccataaaatcaatcgggctattgatccatcccagagacatcagaatggaattgaccggtccactcgtggaaaacagtgtaaaaaataaaagtgcaaatgcagatgccatgatcagattgggcagataaatgacaaccttaaaaaattgtttgtgatgtatctttaatctggcatccgtaaaccagctcgcaagaacaagtgcgatcacaatctgcgggataaaaccgatcagccacagaatcagcgtgttttttccatatgccatcatatcggatttcaacagactgatataatttgccattccaacgaaattaggtccgacctccttaattccggaacggtaatattcataaaaactgtatctgacggtatctgccaacggaatcagtgaaaaaataaaatagataataaaaaacggaagaataaatatctgtccccattttccatagctgatactttttttcttttttttcattcctttgccctctctgccataatagttctgcggagcaaaattgctccgcagtcatggtcttattccggccactgaacttctgtgatatccggataacgctctttgattgctgtctcaaagtttgcctttgccttatcaaaatctacatttccctgcagataatcgctgaacgaattctgaatcagttccacgcatccctgatcgtatgcagataacggagcaatcttgatattctcagctaccggtgcaaagtagacaaacggattctgtccgccaaggaattctgacgagaagtctgcatcatcctttgctgcctctgccattccggacttcgtattcgtgaaatcagagtaatcctgtgaaatctttaacaggttgtcctgattgcttgtcattgcaagaataatatccttcgcatattttacattatctgttcctgttgccgcatggatgtaggaaccaccccagttatattcctgtggcgggttcgtaactgcccagttgccggcctctccatcccagttcggattcagcacaaagtcaatgccccatgccggaagcagaaatgcaaaaaccttggactgggagcccatggacttattccagtcatcattccactgacccttgatgttgctgtccagataaccggcatccagccattccttagaatcattcacccagttaatgattttctgatctactttgacggtggtatctcccggctgaacccaggattcatcaatactgttgccgtacagacggaacgtatccgcataggatgcaaaggtataatatccttttgcctttaactctgccgcggtgtccttgatggttgcccagtccttcaccttctcgccgactgcctcaggatcatctgttccgaatacatcctttgcaatatcgcggcggtatactaaaagtcccggacagcactgccaggtagatcctctctgcacaccgtcagaatcagaagccgtagttctcgtaaaatcatactgatccgccagatccgtctcaggatcaattccaagatctgtcagaggcatggcaacatccgcatccttatcggtatatttaaatacataatccgtctcggacaggaagatatctaccttgtcatctgccgcagcatctgcctgattcataagcgcttcatccagcttctgctgataaacaccatcctgattcggattgatcacccagtgaatctctgttccatccttcagcgttgttaccgttccgtctgaggaagtagattccacctccggatatactgcctcaagacgtgtacggaactcatcgttccaggaatagatgttaattacctttccctcaccactgaaatctttctcgtccgactctgtgcctgcagccgctgcactctccttgccgctgtctgctccggcattggcactgtctgtggcactgcttccacatcctgcaagtaaagtagcccccatagccactgtcagcattaagctgataacccgctgtttcatacttcaattcctccctgtattttagtttttcaacgtcagaccctttccctataatgtctgccgtcttcttgattacagatagaattgtactgaattttatgactggaatatactaaatcaattgtaaaaatatcagattcatgtcataataaccatattcttattttacggaggaaacagccaatggccttttcagaagaatggtacgagaccgaattaaaaagcagtgaacttgagacccttcaccggccgccaaccgtggaatattccttttatacggcagtcaaaacaggggatatggaaactgttgtcgccaactgcaaagaggatgcatttatccatctggagggaaccggtgtgctctcgcgcaatgcgcttaccaacataaaatatcattttgtagtcactgccgccatgcttacacgctactgcattgacggcggtttggagccggaacaggcctatcgtctgagcgacttttacattctgaaaatggacacctgcacaaccgtccggcagattgcggatcttcaccatgaaatggctaaagactttaccggcaagatggttcttcagaaaaaaagttccatcttatccaagccggtcgtacagtgtgtggattatatttacagtcatatcaaagaacgcattaccgtcgccgtgctggcagaatataccggattatccgagagctatctctcccgggtattcaagcagaacctcggcatttccatcagtgactatatccgcgagaaaaaaatagaaaaggcaacgcatctcctgcgctactctgacaagtccatcatagacattgccaattacctttccttttcttcgcagagccactttatccagacgttcgaggactttaccggtatgactcccaaaaaataccgcaataaatattacaaatccatgtggtaactccccgcgaagaagccaccaccggagacaggcacggttcccctttggcggtaagcaatattgcagaaagtatatgtcctgcgattcccagagaaagacagccggagcattcggtacaaaaaatacggcatttctaaccagccgtgatttgcagctgcgatgatccgtgtctttccaagtttggagcactccggcggggcatgtccgcactccgcgagacaatttgtaggacttttgtgcagcacttacctgtgctcccgaaaaaaacataaccgcgcgaagccgatgtctgagctgctatctgccctgatttcaatagctgatagcagcgagtttcggttcgcgcggtttaatattgtctatgagggagcacagttagtgctgccagaaagtccgcccattgtctccggtgtgtcggacatgtgcccgccagtgtgtccaaacgtggaagagacacggaatcagctgcaaagctctggctggaagaaatacgcgcattttttcccgacgaatgctccagctgcttttctccaggaatctggcatgctgtgcttcctgcaatattgtttacccccgaagaaccgtatatgcctcctgtgaagaccactatctgcttcctatcttccaaacaggatttttatgacatgctctttttctgcatccagctgtttgatccattcctttttgatccgcacggcatatgctgcccccgcttccggttccagttgcttttcatcgcagaggacactttttatccactcttttttacactcgcacttttccggatttgagaaccggatgtcgaatttctttcccgcaaaaatcagctttacttctgcatttccctgcgcatcaaactgttccggcatgaatgccggcgcaattaccagatctcccatgaccccctttacgccgaatacttccgtaaccatcgtaaggagataccagcttgccgcacccgtcaggtatgcatacatgcctcttcctgacagatcataatattccggcagtcccggatacatcctgctgttgtcaaaattcattgccgcgttaagaagagcctgcagggctttattaccctcccgcgcaaatcctctccggtacagtgcattggcgtacatgacagccatatgggaaaatactgctccgttttccttctccccgtaagcaaatccaaacattcttcccagatccattttttcttcaccaaaatccgtattcagacggtagccgcccgctttctcatcatacagatatttatcggcactctggcagattttgcggatctgatccggtgttgccgtgccgctcataatcgcaaaaacctgactcgtcagcatcatccgtacctttccgtctttacagccctccaccggattcttatgatcgtcataatagccattaaaccatccgcgtgcctcatcctcagcaatccactcctgcatccttatatgctccatcagccagtctgctttttcctccagattgctacagatctgctctgcttttacgatcatggtctgaccactgagattatgtgcacatttctccagataggcgtccagtatccctcgtttcttttccacattctcatacagctccctgccacctgcaaacagcattcccatctcttctgcaatctcaaaacgcttgcagctggtctcctgctctaacagccggatacagtgcgcaatctcttttaaatttcccgcataagcacttgtaaatgccacgctttctccattttcccatgccatatccagcgcgtcattccagtctgccccgtgcagccgcatctcattgtgcgcgccgacatcgtagaatgcacagagattctgaagaagcagatgttccagtacacttccgaaatagacgacgccaccctctgtgcgctggcattttccatatgtctcgtcccatccggtatcgtgatctgtgcctcttttggactgcagatccttaaaatacggaaccttctcaaaaagaatctcgagatctcctgtctggtcaatataaaattttgtcgtcacaaacggccagaacgcatgatccatccacacacgggtaatatgattccggtccgcaataaactccccctgcgcatttccgataattgtggcattggttccgtccacccggacaccgccgtaattgtcgatgatcatctgccggactgcggaagggtccatgagaagcaatgccagacaatcctgccacagatcccgccagccacgtcctccttttccgtaatcatgatacggcaggaacgaacagccgtaaattctccgcagaattggctggaacgtaatccacttaagataattgtctgcatccggattacccgttttaaatgtgatgtttactttctttgtccagtaccgttttacttcatcataagcttcctttacctggcttctttgtctgagagatgctgtaagaggttcgatctgtgatctctcgtcggtcattccgcccagagtcagatagcagactgtctcatgtggttttaataaaatctccgcaaatttaagagctcccactgcttcttttccctctgccttacttcctgccacagctcccggcttttctgtccggactgcctccggtatgagataggaacctccctccccgataaactccccgacggtcgggtaaaaagctgccggtgcctctccctctccggtggaaccatatacaaaatacgttgtatgattcttctgatgcccccgctcatcaaacgacatcgcaggcgtcacctccaccccataatccgtggtacagatccggtgcagcagggaagtcacatggcggtgatccctgatattgtccgcacttcttccatagaccggcatcactgcaatcggtgtcatttcaagcggttcctctgttatattggtaagttccgtcatcatcacttccatcgctccgtctaccgtaacaaaagaagtaatctctgcttttagtccatggactgcggatgtccgcgtcagtttctgccacataaatccggcttccagtacgcttttctcctgttctccggtaaaccgcagaaattctgcctctgccgacgaaccgcaggctgaccagtatccccggtttttgatacggcaccagaaatttcttgtatttttattgttatggagattttcaatactgaccggctccatcaggaaatggttctgatcccttttgctgtcgccgccgagtgtcggtgtaatgcaggattttaacccaccgtctcctgcaagaggaaaatacaatccactgtagtcttccggctgatacacccggaagcttccctgctgatccaaaaattctatctttcccacgaatctttcctcccatcttatgacatatacaatacgatttctgtctgctttttcaatacttcctgcggaatataatctccctgcatcctgactccatttacaagtagtctgtcgcatcccgactgcacatgtcccggatttttcacaacaatatgtaactggcagcctctgaaaactttatttacttcaaactcctcccattcatgcggaattgcaggcgtaagatgcagtccatagaaatccggacgcatacccagaattccctccacacagccgaccataaccgtggaagcagttcccgtgagccagtgcacatgtgaccttccgaaattcggacttgcctttccttccgtgaactgtccatagcaataaggttcaatcacgcggatctgtgcacggtcattctgtgcagccggtgcattttccataaaataagtaaatgctctgtctccatgtccccgcaatgcctccgccaggataatccatccctgcgactgtgaaaaaatacctgcattttcttttgcacccggattatagatgacagccagtgctccgtcaaaggcgtgcgcatgatacggcgggtccatcaatattgcaccatacggcgtgtttaatttctcatataccctctcaagcgccatatccgcctgatccgcttttgccagcccgctgatcaccgcccagctctgcgggttcagccacatatttgcctccggatccgtgcgctttccgatcacttcgcctgcttctgtaaatccacggataaaacggtcctcattccagcagagttcctgcagcaatttccccagttcctcctgcttttcatcaagataggcagccgtttctttatcctgcttgtattctgcaaactttcgcaatatattcatcgcataataaagctgcatggcaacaaatgtggattccccttctttgcccagtcttaagcagtcattccagtcggcatacagccccgccggcataccgtgttttcccagatggttcatggaaaaatcgatggcacgcttcagatgctcgtaaacagtcgcctctccccggtttgcatacggaatcacttcatccataaattccagatgtccggtctccgctatatacttgtagacggtcggaaacagccagagcgcatcgtctgcacgatatgccggatgcccggtctcctttacataagatgcatcatccggcgtatcttcatgtcccggattgtgtgtaaactttaccagtggcagtccgcctccattatccacctgtgcggaaagcataaacctgattttttcaactgccatctccggtgcaaggtgaatgactccctgtatatcctgtaccgtatcacgataaccgtatccattgcgcagtccacagtagacaaacgacgctgcacgcgaccagataaatgtcataaagcagttataggcgttccatgtatttatcatggcattgaattcttcactcggtgtctttatctgaaaatgtgcaagctttccatgccagtaatcggtcagctgctgcaattcctttccacagacctgctccggcagcgcataggaggccaaaatctctgccacctcaggttcctctttcattccaaccagaaatgcgaactcacagtgctctcccggtgcaagccgcaccaccgtactgagtgctccgcagctgttgccgttctcatttccctcgttacacaatgttccctctgccacacctgccggattgccatatccatgatatcttccgaggaacttctctctgtcgccgcaccaggatgtcactttcgctcccttcagtgcaaagaaacggctgacaacgattttatcatcgacatcgctgccttcctcgatctgatccagattcgcatgaatcatctgccgcacatgatccccacagaaaaccgtgcgcgtaataaactgcgaatactgtaaattcacctgatcctgctcatagttgctgttgtttgtaaattcagcgtacccggtaaccgtcagttctctttcttctgcagatgtgttggcaatgcatacattccacacctcatacgcccggtctagcggcacataatatctcacttctgagtgaataccgctgtaatccgcctgcatttttgtataagcagttccatggcggcattcactccggtaagttttcagatcctttcccaccggctgccaggaagccgaccagtagtctttgcttttattatccctgatataaatatatcttccgggttcgtcaaactggttaaagatgtatcttaaaattcttccgttagctccggattttgcaaaactgtatccgcctgcattgtttgaaataatcgcgccatattccggggaaccgagataattaacccacggtgccggtgtatccggtcttgtaattacatactctttcttcgtctcgtcaaaatatccatatttcatatatgctttctcctgttttgattttctaaggttttctacattaaatataaccttcctttgaaaatcagaataccagatacgacattaaaatatcagattcatgacctaactttattcagtaaatacgataattcccggacagtgccagcatggcaaacagatacaggaaattgtcgtaataacggcgttcccctgtccgaagcggcgtctcccagaaccttctgatgcactcctttgcattttctcccttcgcagccagcgaagcctctgcatttaccgctatcaccgcaaccgggtgcagcgcccgctctctaagaagcgtgccgtccgtcagaaacacaccatcccagtgtccgctctgcttttcgcagtaaaagctctgtaattttcccgcaatctcctgctgccagggatctctcccaaaccacagccagtccatggcaatattcgcaatcgtccggtacgcatcactgtaataccagtcatgcctgccgaaaatctcctgatgtccctcatgcggagtcccgtcatactccgcatactccgccgacaaaccggtgtccggatgacatgccagatgcagatacgctctgctcgcttctgccgcgtctctccagaactcccggtcatcttcgtccgcccatctggcaaataattcataaaaatggggcagatggtaagacggatcgctgaaattacaatttgtaataaacttgatcagatgcctggatgtgtcccacatcggttcccccggatgccccggctctcccttgtggatgcattcccgcagaattgcccgcgcctcatctgcatagtggaatattccggttccatttccccagcggtctgccgcaaaaaacagtgccatggcaaaatattcttctccgtcgggagccggaccttccgcatttttactgccatctgttgcacaggaccacgcaaaataattcttacatggtccatcctcgatgtacatatatgtccgggtccatttccacagccggtcaaactcttccctgcggttcatctgcacacatgccatcattccataggacattccctctgtgcgcacatcatggtttcccgtatcctctatgtatgccatgtcggctcccacctcatgatagaaacgctcctcctcattcccataaaaaattgtctcaaatgtctgctccactcttctctgaatctccgcttccggatacccgtactctgcaaacacattgcgatactttcccgtctcaaatgctcccgccatcgttctactccttttctcctctttcctttatgtgtgatacgtctctttgggtcccagataactttccaggacatccgttccttccgggcggatcaacagcttttccagaacaaacccaggtgtgacggaataaatgcgcagacggttgataccacttctgcatgaaaccggaatctcctgtctgcgtatctggtctaatacaccttttgcccagaactctccctgatctccgatccggtatccctcaggtactgcgttataaatccggatctcaccaccgttattctgcacaccgtagcagagtttctgatcgttcgccaccggattggagggctgcatataaagcgtaagtacatacccgccgggctttgatacccagaaatgatactccagatacggtgcattttctcccggcacaccatacgctgtgaccggaaatgctttcatggcagaccgcgtttttccatagtccctgatgcattgaaaccgtaccttttcgttttttccttcccgcttaccatccgctgcatatccatccttccggtctgcataatgctctgcctccatcacaatataacctgccgtatccacaaaggtaccttccggtacttccggcagattttcacataccggtatctcgatccggcagcagccggaaggcgtttttatttcaagcactccacaagcagacgtacctgtatttccatcccggttcattgcccaacgctcccggttcattacaagttccagcttttcataattgtgctttttcccgtccagcacgccctgcatcggacacaccgaaagccattccggtttttctgtgacctcgtatgcagcctcacattcactcagcccatacagggtgatcccggcgctcctgcacgcagggtctaaaaaatccggcagtttcatggattccgtaagccacgggcttccctctgcatgctgcatcgtctgatccactgtcacaaccagtctcggtttatccgcgggcagtacccggtgaatcacagggtttaaacattcatcctcattccagtgcacaaatccgatatgctccgatgctcccatgccatcccagcgtccgtgatccatctgatgatatgccgtcaccagttcccggtcacgcttcagacactgttctaccgcatccccgtaatcattcgcgcgaagtgctccaagctttgccaggtattgattcatccctgccagaagatgcatcctggtcagattcagtgttcctgccgcagggtaatagatgagcgccacaaacgccgcttcgtattccggcgcatgttccttcacccacgcatacacacgctccgcttccgtaagtatccgcttaatctcctccagtgtatcctgcgtttctcttccatgcaccgggtgatacaccattgcacgcattgcctcaggtcttctcttttgtatcaatctggtatatccctgcagaacgtccgcaatctgttcctgtatttcctccgtaaagcttccaaactgctgcctcgtccactgtctggtatactctgcggtctgattgacggcaccacttccccaacgtccaaaatcatatgccatatccagaaaatacgacagtgggaactcctgcgttgcaatatcccccacattgacaatccaaagttcccgcaccccgaattcatatgccgttgtcatttgttcccagattttcggaaggtacgaactgttgatccattcataggaaatgggccagccgtgatagtccagatgatagtacatcccatatccgcccttatgcgtcctcatctcctttgtcggcagtgtcctgaggtttccatagttgtcatcacacagcagtaaaataacatcttccagttcttccgatcccatcagccccgccgtctgatcatttccataaaaaaacgcttccacttccttgtagagagcaagcattctcgggacacgctttacgtcctcatccacacactcccggatcagctcattctgcgtttttagcacatcgcgcagcagttcaatattgtcttccaatgttgctttttctccgagaattgccgtatccgcctctccacgcatgcccagggtaatcacattttcaaattttcctctccgaagcagtccgtctttccagaaccggatgatgccttcccggttcgtccggaaattccatgcatcgccatataccgaatcttttcctcgcaggtacttatactcctccccctgtctcagacacggctcatgatgcgacattcccataatgattccgtattcgtctgccagctttgcgtttgcaagtcccgggccgtcatccccaaatctggcgctccacatcgccggccacagatagtttcctttcagccttagcagcaattcaaacacatgctcataaaccgaagttccaaatcccccaaagcgccggttgcaccatgttccaaatgccggccattcatcattgataaaaaaaccgcggtatcttacagacggctctcccgccacacacgccatcgatgcacgaagccccacatgttcacggtgaggtggcctgataccacaccagtcgacaaacggagatacgcccagaagttctgacagatgaaacagtccgtagattgttccacgcttatcgctccctgcaatcagaagaatctgtgttccatgccattctggatcgttcagaaaaaaccagccataacactcccgttttccccggatctgttccagaccgattctcttttcttcctccatctgctccagaagtctgctttttccaaccgtagccggaacaatcacagtctctgcccgttctgccacatccgcaagttcttcctgtgatgtgccgtacagcacccgcgggcgtctgtccgttaccagctccacatcgccggcaactttatccgctatcttctttaccccggaatctgctgcatcttccatccaaaatataatctcttccatattttcaatccttctccttaccggaaagagttcttcagctgctctgccagctgatgtctgcgggatgtccagtcagatccatcctgtacctttatcatcgcccgatgctcttctcccggtatcaaacggtatttttgaatgatctcctccggaatcctcgcttctttccgcttgctgcacttctgcatcacaagaatcatttccgtcatttttccctctgcgataagccggtcagccatgttggcgatttttccctgatgaatccacacacattcgctctcccaccgaaagctctccacaataagaacaggatacctctgttttgcatgcttctcatatcctgccggtgtatacacataacacaggcggtatccgccattttcttcctcccggtaccattccatatgaagcatgccatgcggcacattcgccagctgcggataacagaactccggttccggaatctcaaaataattgcatgcaaaactgccctgttcgttatatccggcataccctgccggaacttccggatgaatcgtctccacgccgttgacgataaaatgtacctcatgatagccggcagaaagtcctcctatttttcctcgccatattcctggctgctgctccgttaacgtagccaaaatctcatgcttctccttaagccggacatccacacgagccgcaccgggtgcctccagatagaattctgccgtgccgtcactgcacacttttacgcccggtatggtctttggatatttccctgccggtctcccctgcgcatccgtttcaaaccggatctgccggtgtaccggatcaaaaaagagcatctgctcctccatgctctggacggacagctgtttttcatccaggcggcgctccatgcagcatgcagatgccgtttcttccacagtctctgcgccacaaaacagaagcggcacaaaatctctcagactctttctccagacatgccattcatgatagccttcatatactttctttacgcaaagcgtttctgattcgcgcatttttttacagatatcctctattccgcgcgaaatctcctcttccctgctcccgcaggagaaaaacacaacatccggtttttctgcctcatccgtgcagatcctctctgcgtcataaagcgataccccggaaaacattccaagtgccgaaaatttatcccggtgcctgcatacacttcttgccgccagtgcaggccccagtgaaagacctgccagtgcccggtaatttctgccccgttttaccggaaaatgtgtttccacataaggaatcagatcctccatcagctctctgtcaaaatccccgggaaagaaaattgcctcctcaccctcgataaacgcataatcacagctcatcaccacgatcatttccctgcatttatgctccgcgatcagattgtccatgatgtaatttagcttcccctgccagatccatcccgtctcattttcaccgacaccatgctgtaaatataagaccggataccgccggctgggatctttctggcttccataaggcgtgtatacataacattctttcaggtgaccgtttacaccggatgcgtactttgccagatgcaccgttccatgcggtacctctttcagatagtaaaattctgctccgcgctccggcacctcaaatgtgttgattgtctcaaagcagccataagaaaaaccggctttcggatgaaacagtttcactccgtccacaaaccagtgataatagtgcattcctcgcgggaagttctctatcttcctgtaaaaccctccgtttccatccggcaggagtgcaagcggcgccgcatcaaaataaccgcccacacccgccacttccaccgtctcagccgtcggtgcatacagatagaattctaccgtcccatcttcccacaccttcaccgcctgccgttcttccgttatctccggcgcaaacgaaagtgcctgctgcaccagcgcctggttaagttctgtccccataaaaaaacctcccattctataagatcttctgtgagaatatcgtatagaatgaaaggttctaccggcagatgcggcgcatcacttcctgctgcagatcctccatcaaaatctgtggactgcaggcattgtatgcatccatgtattcctgccaggctgtatcaaaatcctctgccataataacccgcggaagccactcgtgcttgatctcattgatctgctcatataccattcctgcttctgtggtatcagaaagcgatgtagcgtaagaatacatcggataccagtttcccggtgccttatgattcccaatcatatccacatagctttcacagccatacgccctgagacatttctggacgtcccccggctggctttttaaaaattctgccggctggtattccagtgaaaaagcatttttcccatccggaagcattccctcccaacgtgggaaatacgagtaatagcagaaatagtccgatgccagcagatcatccgaaaaacgctttgactgttccttcgtcagatagaaaaccccttcctcatccacgcaatagtccgttccttcctgcccccagaaacgcagaatctccacctccggctttaaaagatcattcacaaactgcaaggcaccgtctatgtcttcacacgagaccgtaaccgacaggccggaggacgtatcgatagatgccgctctctcgacatgccactggttctccaccccctcctgcatcgtaatcggaagcggtacataatcgcatccctgctcactcaatttctgtctgtcatatgccggataaatcgcatagtaaaactgccaccactgatccaccattccaaggaccgctccggtggacagcttattcagatactcttcatagctgtttgtgaacgcctccgcatccagtattcccttacgatattcttcatttaatttttcaaaataagcccgcgccgtctctgtcgtgttgtaatccatcacctgaaaggtctgcggatcgaccatgcagcagccgtcattgggatatccatccagaaactgcggcacattctccaggcaaaaatatctccagtcatcgctaagaaccgtaaatgggatattcctggttccgttctccatcatgggattggcattcacataagcctccagcagatcgaaatattgctctaccgtatgaacttccggatatcctgcccattttaaaaccctcgtctgaatccagaatgcttccccgtcatggatcacatcgctgctttttccatttgtcaccccgaattgtggaatccagtaaatgtgtccgtcttcctggcgcagcatatcccactgctcattcgtcatgtattgccggatattgggatattcctcccagtactcatcaatcggaatcaatgcctctgcttcgtataagtttttttccccctgtatgaagtccggatatctgccgcgggcaatgtatgaattgagtgcctgctccttggtctgaccggacagccagagttcttcacactctgctcctgtcacctctgcaatcttcgctttcatgatatttccatattcaaggctgtttccctccgtcggaaaaaaagccgtaaaatgctttatctgcgcttctgccatgcggtctgtgtgtgccgccatgttccacagcaccagaagcagtaccattaaggtcattccttctgccagtctctttttcatctgttttccctcttttccagtcaattatactgtttttaagggacaccggcaagatgggattgcatacgctccttcgcttttatatggaattattcttttacgccaccgagtgtaagaccggtgacaaaatatttctgtaaaaacggatagatgcagataatcggcagcatcgtgagtatcgttgccgcagagcggactgacgtcggtgtaacggttcccactgcattcttcatggcttctgccgaagttccctgattcgtgacggatgacagcagcttcatcagctcatactgcagcgtcgtcagatcagaattcatgcggttgtacagcatggcatcaaaccaggaattccattgtccgactgcaacgaacaatgccaccgtcgcaaataccggcttgcagagcggacagtaaatctttagaaaaattgtcgtatatccggcaccgtctaactgtgcggattcttccagactgtccgatataccattcatgtaagtgcggattaccagcatattaaacgcacttaccatgcccggaattacatacacccagaaactattggtaagaccgagtcctttgtaaagcaggaatgtcggaatcattcctccattcacatacattgtaatgacccagaacagggaaaggcttctcttaaacagaaatcgtttccggctgacaacaaacgccagaatcgcgtttgcagccagtgccagcactgttccgataactgttcgcgcaaccgtgacatatgcaccggtaatcagattatctttctgcaataccgtgatataatttttccatgtaaattttctcggccacagataaattccgccacgcaatgcatccgtgccatcgtttaatgaaatcgccagcgtattcagcaccggatataatgtgattacaacaatcacaagcataatgattccgttcacaatgggaaatgcatcaacggatcctgttctctttctttttttatttgctcctgccagctgttgcatgctattaccctccttagaataacctttcttctccgttgcgctttgcaatctggtttgcaatgacaatcagaatgatacttaccgcactcttaaagatacctgcagccgtaccaatggaataatctccctgactgataccccatttaagtacatagatatcaatcgtctgagacactttctgcaccagtccgtttcccagaaggtactgaatctcaaatccggcatttaatacatttcctacattcattaacagaagaatcataatcgttggtttgattcccggaagtgtcacgtatttgatttttgcccatcttcccgcaccgtcaatggaagccgcttcatacagggacggatcaatggatgtgatggctgccaggtaaataatggcattccatcctgtctctttccacacattggcaaacgcgacgatcggccagaaataattcggatgtgcaaaaaaattgattggctgtgtaatcacatgcagattcatcaatatctcattgatgattccgcttcccgagagcatatcatgcagaattcccgttacgataatccaggacaggaaatgtggcagataagagatggtctgaacaacctttttcccgccatgtgattttatctcgtttaagagaatcgcaaatgcgattgctgtcacaaatgtcacaaccaggtttatcacacccatcgcaagcgtattccggatgacacggataaatgtcatatccgaaaataaggtctgaaacttctgcagtcccacaaactcagagtggaaaattccaagctttggcttataattctggaacgccatcgcccatcccgccagtggaaggtaatagaaaatgatgccatagattaccatcacaccactccagaacagcagaactttctgtctctttatttctttccaggtgatctttgctttatattgattttctttttctttggatcttgttctcgtcaaagccataccccactccttaaaaaaacaggcagatgaaatcttccttgcatctgcctgtttccaatttcattttatgtgttattcgtatttcgctgcttcttccattctcttatcaagttctgtctgtaactcaccgataaacgcacccggatcgcagctgttgtatgcatccatgtactctgcccatgccgcgtcaaaatcttttgccatcacgacctgtgggagatactcgtgcttgatctcaccgatcttattccatgccataccgccttccgtatcggtagtgaagctgtttgaataggaccacatcggataccatgcacccggagcttcatttgttccgatcatatccacataggtctctgcgccataagcagaaaatgcttcttttacatcatcatttaatccgtcaaaaaattcattcgcctgtccatccggcttattcgcattgattccgtcatcacttgtaccggaatactgcggaaaataagaataggtacaggtatgggatgctttgtatgcagtgtcaaccgctctggttctctgctcctctgtgcggtaaaattcaccgttgtcatccacattatagtcaacgccttccactccccagaaacgcaggttgtgaatatcctgtgagaggaggtcatctacaaactgcagtgcagcttccacatcctcacagcttgtggtgatcgcaagaccgtctgatacatttaacacaccgccggaacagtgccactggtttttgacactctcatcaatggtaatcggaagcggaatgtaatcgcatccctgtgcatccagccctgcctgcttgattgcatctcccgcagtgtaagcaaaatcccaccactggtcaatcatgccaagtacacgtccggttgacagtttggcaatatactcatcataggtctgtgtaaaggattccggatctacaattcccttctgatattcttcattcaatttctggaaatactttactgcggtatccgtcgtattataatcgatcaccgtcaatgtctccggatctacgatacaggagccgtcgtttggatatccatccagaaactgcggcgcattctcaaggcagaaatatctccagtcatcgcagagaatcgtatacggaatgttctctgttccgtcttccatggtcggatttgcctcattatatctctcaatcagatcaaaatactgatccatggtacggatctctggataatccgcccattttaataccctggcctgaatccagaatgcctcatcgttgtgtgtacaaaccttctcttctcccttgatattgctgaactgcggtatccagtagatatgtccgtcgtcctggcgaagctgatcccactgctgctgtgtaaagaagtttttgatattcggataatcatccagataatcatcgagtgctaccagaacgtctgcatcatagagctgtgactgtccgcttcccccgcagataaagtccggcagctcaccaccggtgatcatcatgccgacagcttcctctgccgtctgtccggtcagccatgtttccttcactttcacgccggtcttatcggcaatgatctgctgaatctcattgtcgtcattgatctctgaaccgggaactgcaaaaaaagccgtaaattcttttaccccaccggcttccgtgctgtctgcaccgtctgcgttttcctttgcgtctgtcgatgccgcatcactcccgcatccggcaaacatggctgccatcattgtggctgccagcaatacactgataagtttccttctcttcatcttgtaactacctccctatttgataatactattttacctttctggcagattcagacaattggaggaagtatagataaaagcagggcaaagtataggttcttatttccatactttgccctgcttttgaacttgccgtatttcctttatgcctcacgccggaacttcgccggtgtacagccttttaccagaataaaacggttcacaaaataatcaagatcatgatacccgacttcctccgcaatctcgacaatcttcttatcggtatgtaacagcagatccgctgcccgttccattctgtaattattcagataatctttgaatgactgcccgtttttcttacggaacagctgtcccagatatgcgctgttgacgtaatatttttcactcaggctctttaatgtgatattctttgcatagttttcccggatctcacgctcaatctctcctaacactcctctggatacatttttgcgaagctgcgacagatagtccccgtattcacatgcaaaccgggtcagatgcgccttgctgccgcgcattacccccttttcaaagctactctcactgatcaggcgcagaatctcttcctgatttaccccgtcatcctgctcactcgccagatggatcagctgaaacagaagataattgatgttcagattcatcgtctcaccggtcatttccctgcttatcatctccccgtaaaactgctcaatcgcactccgtatctctacatggttgttctgctccacagcttttaacagacgatccagactgctcttgcataaaacaattcctccggaagtaacctgcacttcctcctcatagtaatagatcggcttttttgtgcggaatccctgaaaagaccggagcatacacgcatttccataagatctggcaatgttgctgatatcctgcacctttttccctacaagcatgatgaccggctggtgcatgttagcaatcagatactcaagaaaccggttcagatatgttttcccatcaatcccctgctcctttgcaaacgcatcacaatacaataacccgatgtcataaatcttctcatgcgttgagacatcaaagacacaatgtgatgcatggggtcccaggaactcaatacaatactggtacagctgccgctgaaagccccgtttttccttatctgatatttcctcggctctgccgtcatcatccatctgaatctctacataccgtataccggatgccccatccatatgcgacttcacatactccagattcacactgtcaaactttccctgaatcaatgcgatcagatgtctggacagatacgcctgctccatttcccggctgctttgcttcttctggttgtccgcccttcgcaatacctggactttattcagcaccttcagcaattcttcccggtctaccggtttcaaaatataatctgtgcagtcgtaacggatcgcctttctcgcatactcaaaatctgcatatccgctcaggatcacaaaatgtgcatcggaaatcttttccctgcgtattttttccagaagttccagtcctgtgacgaccggcatttttatatccgcaataatgagatctacctgctccccgcgcagatattccagtgcttcctctccgtttgccgccgtcttaacaacttcaaatccctcctgctcccagtcaatcagtatcttcagtccctgtaatataaacggctcatcatccacgagcaatacctttaacaatgcttcccccatctttttccttcccttctctacaatggcatccggatactcactgtcgtaccgataccctgctccccctctatatcaaatgccacctgctccccgaataccattttcagccgcagacatgcattgatgattcccactcttccgccatcctttagcatatcaatactggcgtttagcatgcgctcttttaattcctgcatctgggaggcgtccatgccgcatccggtatcttccacttccagataaagtgccttctgcttttggcagatccgcacaaaaatccagccgggagctgtctttgcctcaattccatgtacacaggcattttccacaaaggtgacaactgtcattttgggaattttaatgtccaaacaatcctcttccacttcaagactgtaacttaaccgctctccaaaccgatacttctgaagccccagatacgctctcacaaattccatttccctgcggatctcgacactgtcgtttccccattccacatactgacgctgcatcagcgccagcttttccaccatgtctgccgtctcatattcgtttttcaacaggctgtgcatgcggatgctctccaacgcattaaacagaaaatgcggattgatctggctgtgcagcgcgagcagttctgcattctgtctttccaccagcatctcctgttctttaatcttattcttatacacaatctgaatgagttcatttgttctcgcaaccatgcggttgtaattgctcatcaggcttccaatctcatcttttccacgcacatacgaaatcggcaccagatgttccccgccgactgtctcaaacactttgctgagttcgctgattctctgcgtaaatgaccggttaaatccccgcaccagaaggagtggcagaatcgcatttacaacaattaagaatccaatcagcggcaggtttttccggatttccgtccacagctggcgtttgggctgcatgacataaatatccagatccattccgtaaaactcaagttcctgacagtatccgaccctgcccgtctggtcaaatgtctgaaattcctttccgatactggaatatctgccatttgataagacaatcttatctccctggcagataaatacatccgtgtcataattcattttctctaatgtccggtttactgcactgtaatcgatgttgatcagcagcaccttttccatattattttccgcataaaagtccagcttctggaaaaaaagcatccgtctctgcggctccaccgaaggtgccctgctgtcatcatactggaaatataatcccttattcaatccgttatcctgaaaatagcggtacacttctgtaccgcgtatttccttcatattacatacctttcccccattcacgatcgtgtcattatccgcatacatcgtgattaccatgttgttcatgccaagtccgctctcaaacagggtatctttaaaaaaatcctgataactcaccacatagtccaacggatcgctgtaggtattcgccaaaaaacggttaatatatttgctcgtataaatactcttcccgatctctgctgcattgttgaccgtatttgaaatactgtatgcaactgcattggcaatattcgccatctcatgctctctggcttcccgctcagacttcatgacaacagaaaataccgcactgtccgtcacaatcagcggaaccagcacgcacaagatatacaggatataaaatttattttttattttaaagtcatccatccaggcttcaaccgcatgcagaattctcttcatatcctctcccagtatttttatactaacattgtttttcatcgagtgcaacggataccggcagcatcagtattccacttccgtcacatttcccgttttgcatataaaaagtgtgctcaccgtctgtccggtcagacggctgcttctctcatccggctgctgccctccgactgcgatctcatagcttcccgggtgtaccagacattttccctcctcggagatcagtgcaaaatcacgcggagaaagggtgatacaaacctctttcttttccccacattccagtgcaaccgaccggattcccttcagctgatagccgggatcgtaagcttctctttcactgaatctgacatatacctgtaccgcttcctgtaccgggtaggtaccggtattctccaccgttacatgcaccgttaccggctccagtattccaaaatctgtgacatctgcatgtgcatcagaataacggatctgcgaataggtaagaccatatccaaacggatagagcacatgtctgtccgtataccggtaggtacgtcctgccatggaataatccgtaaaatccggaagaaattccgttccttcataaaaggtaaccggcagttttccgcatggagagaattctccgaacaatgcctctgcgattgcttttccacctctcgctcccgggtaccagcaatccagtattgcccgtatctgtgcatgttcctgcgcccacgacagatccagtgcacttcccgccagcacggtgagcacaatcggttttccgactgctgcgaccgcctctaaaagttcctgctgcagtccgggaagctttaatcccagcttgtcaccgctggcatactcatttcccgcatctccctcttcgccttcgatgcccgcatccaatcccagacacatcacaatgacatctgcccgctccgcagcaatcagcgcttccttaaaccggtccttcggctccccgaggaattctacctgatccttatacagatggcagccctgcgcatataggacgcgggttttctctccggtgtattcctgaattccctccagcggtgtaatgtatctggaggatgtcccctcataatttccaaccagcgctgctctggagttcgcgtttggtccgatcactgcaatggtatggacctgttcctgcttcagcggaagaaaatggttgtcattcttaagcagcaccatacttcttttcgaggcttctaaggacagtgcaatatgttcggggcactccaccacatcataaggaatgttcgcatatggagacggataatcctccatcatccccagccggattctaacatccatcaggcgctccaccgcttctgtgatcgtcttttcctccaccagtccctgttcacaggcacggcttaaatacaaaaatgccttcccgcagtttaaatcacagccatggttgacagccattgccgcagattcttctaccgtctttgtcacatgatggtgctcatgaaaatcaagaattgcccagcagtcggacactacgtgtccctcaaaaccgaattgttctcttaaaatatcctgcagaagtgtcttgcttccgcacgccggttccccgttgacgcggttataagcgcccatcacggcttccacaccggcatccttgacacaccgcttaaatgcatacaaatacgtatcgtacaaatcgtgcagcgacacctttgcatcaaactcatggcgcaatgcttccggaccgctgtgcacggcaaaatgcttggcacacgcagccgcctttaaatgatccggatctttgccctgaatccctctgatatacgcacagccaagctttgccgtcagacagggatcctccccgtacgtctcatgtcctctcccccagcgtggatctctaaaaatgttaatattcggcgcccagaaagtcagacctttataaatacctctgtctcctcttcctgaatacgcttcaaactttgcccgtccctcggtggacaccacatctccgatcttctcaatcagttcttcatcaaaagtcgctgccagggcaattgcctgtgggaacattgtcgccacaccggatcttgccactccgtgaagcgcctcattccaccagttatacgccggaatatgcagccgctcaatcgccggtgattcatagcgcatctggctgatcttctcctccaacgtcatctgttccaccagtctttttgcatattctttcgtctccagactcatctctccctctccttttgctctattcttctgctccactgcacgtaaagctcacataatccgcataatttttactgtcagttccatgcgaagacgcgtacattccaatggtgcatcccacaaagcctcccgcctcttccgtggtatacgcaagcaggctgaccttatcgcaggcacagatcattttttctcccagccttacccagatacccgcactctgctcctctccgcggatcagaatctcccataactcctgctcttctttcagaagaacttcacggatgacctcttccctggcatgaacatatgtgctcacccgaaagcagacatctgttccctttttcccgatctccatcctcagatgattctcatggttctggtataataccattcccgccgtctcatcctccgactgtggttcaaagcggaatctgaccgctgcatggaaatgatagcttttctgccggagtccgaaataactgctgcatcctttttcaccgatcgtctgttttccacagtataagcggaatacaccgcgtttttctgtcagcgaataggatgcctcatttcttcccccgatcccaagcagcctctgatccggtctcgtctcccagaaacacagggtatcgcacgttcctgtttcttccggaaaccggtactcttttagcggcacttccagtgtcttctccagacgtccggttccggcagcaattaccggccatccatcctgccatacaacttttgccagaaaagtctcgcgccccatacttccatggttcttacagcgtctcgtggcgagcatcaccacataccagttcccgttttgatcctccaccagatccccatgcccagcatagaccacaggataatccgccccaagattccgatgtgtaaagatcggattgcgcgggcatccctcaaaccattgaaacagctttcggcttctcgccacactgatgctgtgttccggtccggttcctccttctgcatgcagcagataataatagccgtcttttttgtacagatgtggtccctccggccagattgcccctctcacagcccctttccagattgccatactctctccgaccagcttcttcgtcgtcagatccagttcctgcacccagatctcccagtccccattgtaccttactccatcgggattcggtctggttccgcaataatagcacctgccatcctcatcaaaaaacaggctgggatcaatcccggctgcttcttctcccagataacagggatctgaccacggtccctccgggtgctccgccgtcacaataaaattacctccatagctgacatttgtggtaatcatataataaatacccttatggtatcggatggtcggcgcatagattcccctggaaatctcctctcccccaacagcaagctgctcttttctctgcagaatatttccgatttgctcccaatgtgccagatccctgctgtgaaacagcggaacacctggtgcatatgcaaaactggatgttaccagatagaaatcttctcctacccggcagatcgacgggtccggataaaatcccgtcaaaatcggattcttaactgtaaccatagcttttcccccctactccacatatccaaatccgagaatcgtaaatttcttatccagattctcaccgctcatctggattctcacggtatgtgctgccgtttccttctcctgaaatacgagcaccgcattacagtgcagccagttattgacatgtggatctgctgtgaaccggaattccccatccaccagcacatccgctgtcccggcatccacctcgccggaatccttaaatatcagaaataacgctctgcatgtgatcgtcagttcaaaaaacgcccgatccggcttagttccatcatacatccagttatatgggaattccggcgtagtgcaaagatcctgatccatttccacacactgcagttcgtgatctgtcgcatcaaagcctccctctctcatactggcaccctcatatccgtcccgccggtctaagagttttactttttcaaacgaattgccgattgcaggctccccgcgcagacactgttctaagacttcctcctccgtcatgccctgccggaagctgtccaccctcgcatggtcggacgtatcacatatctccatcaggtattccagacaatctgccataatggtatgtccaaggttggtcggatgaaacatgtcataaaaaaactggttcttcgtaatcactcttttctgttcttttccggaaaactgcggggtaaccgcatccagaatacttaccatcggaaggtcgtactgtcttcccaccggctgcagacgttcctgaagattccagtcatttgcaaatacggaaaacaagagtaccaccgcaggtctccacggcagcttcaataccttacgcaccagactctcatagcagtcccctttggtctcatctccctcatcattcaccgcaaactcgattacaacaagatccggctgttccccctcacgcaacacatctctgtcaaaacggatcattccaagctccgatggggttcctcctactcccgccttgatgaatctgacattattgttccgtgcaaatcgtttctgaaacagctgatatgccttatatgcataacactctgtgtgaatcggcactgcccctgccccctgtgtgatggaccctccgataaaagcaagcgtcacttcttttccggctcgcgctttctcaatcactttccggatgcggtaggtatttcccaggttcataagagagcgctgcaccatcttataatattcttccgaatggagatccactttttcttctgtcagatcttccggtgccgtaaatccgtcgtttaaataaaaacggacatctgcctttcccacccgttccggctggtcaaatgtaaagcggatctgtccgggcacatcatcatccagactccattcataatccgacagacagatcctctgttccatcccatctccctgcagtgttgccaccagattcgttccgcccccatacaaatcctttttgccgtacatctgaaaaacaaattctatcttttcagccggatgctccatctcaaccgacacaccaatactgtgtacaagcgtgcggaagcctttcactgtaccgagcagttcaagtattctgctatccgtgatatttccgacaatctgtgcactgtttgccagacggccgtcactttcatagatgaactgcactgctttgccatctccctgcttcagtccgcagatctcttttccacgcataatataaaaatgtgctcttgctttttccgggtctctcggtgccactggtcctgtcattctgtgctcctcctgccattttattttatatacatctatggtagcacagatttccttccggatacgcgggagaaactatagatattactacgataaattagtgttcttgcccctgcccccgcggagcgttttaccggaagccgtcacatcagaaataaacggctgcctttatgcggtaagtaatgtgaggagaaccgttctttttctgatgtgactgtcttccggtattgattcggcagcattccgtaccgcttccggaacagattggaaaatgccttgctgtttggaaagccgtggtttaatgcaatctcgccaatcgcaagatccgtctcttccagatccctcacggcatgctccagacgcacactcgacagatattccttgtaattgatcttcgcatatttttgaaacatccgggagagatacgccggtgaataaccaaaaatccccgccagtttttccagcgaaacatcctccgtataatgctccttcagatacccggtaatccttccgagacgcttaagctgcttattgttcttaagtatctcttcgcccacctcaaacttccggtatcttgtcaccagaagatactccagctgataaaaacagcttagcatttttaattcgtaaccggtctgtttctcaccgtacgccacaaacattgtctcgagcagagaaaacacctgacggtcatcctcttttccgctgtgggaaaaccagataaactgttcttccgtataataatccgcaaagacggcaagcggaatctgcagcacaatcgtctcgtttggcaggggagcatggatcgcatgcacctcattgctgttcaccagcacaaaatcccccgctgcaagtacatattttttctcattcaggaaaaactcaagctgcccctgtctcacggcaaatatctcgatagaacggtgccagtgcttctccctgatgtattttccgccgccgccctcaaagagaaacagcttaaacggaagtcccctgtccggaacgatcacttcatgctgataaacaatatcattcactccacttcggtctcctttaacaaaatttcattaccgcgcagtaagctgaaaccgccggttttcaccagccatcctcataaaatatactgtatgttttttattttgttaaaagtataacataaatttcaattttctcatttatttttcacaattaatttatattttgtttatctttctttgaaatactgcacaatttcccttgtcttcttttttcgtcttttttcgcacttccacaattcttttgttttccctactccggcagactgtccgacaaacataaagttccccaccccacctgcggattcggatattcctgcagcagaccagaagctcttcctcctcccagcgggcgcgcaccgcggatcaggtacgcctttattttttctccgtacaggtacacatcgtttccgcgcacaatcccccactccatcagaagcgcggcgctccccgtcacaaacggagttgccatcgaagttccggaacgcgccgtatagcctccgcccggcgcacaggaggtgatctccacgcccggcgctgccagatccggcttgacctgtccgtttccggtaaatcctctgcctgaaaatccagccagctgcccgaaccgcgcgtcgtacgccccgaccgtaatcaccttcgccgcagtggacggaatggtaagcgttgtctcctcccgcggcagaaggaatccggtgccttcgtttaaaacgcctcccgccgggaaccacatatcatagcgccccgtgacgatgcgctgcggaatcaggcgcaccgtccagattccactgtccacatagtcgcgcacgggaaggaaatccaggtagatctcctggtaagggctgtatgggctcggctctccatagtagagcagaatctgcgtctgccccagcgtaaaacgctgcgatccctgtatctggcggatcggtccgatctgcatgccgcccggatgaatgagaagcaccgccatctcatccgcataggatttccagatctgaagatttaaggcgctctcgtacgcgctcaccgcgaactctacattttccgcctgccccattccaagcgctcccgccgtgtgcgtggcagccgctccctcattcccgcttccgatcacgatcgagctcttccagtagtttgcgagatcatccagataagtctcgatgagcgacgttcccgtgtggcttccgtaattattcccaaagcttaagttgatagcgaccggctgctgccgctcctgcgcttttctaatgcagtaatccaccgcctgcatcagttccgttgtccgcgggaacgccccctcccgctggttgccgagctttacaatcaaaagatcgctctcatacgccacaccgcggtatcttccctccgacgctcttccgttgccggcggcaattcccgccacgtgtgtcccgtgtcccgatgcatccctgctcgggcagaccgcataccgctgctgttccgtgggctgcgcgagcgcctcgttgatgcgcgcctcatcgtactcggttccaaggaaataccccgccggcgccgacaagcccccggacgccgggatcgtctgatcccagagactgacaatgcgggtcgtaccgtccgccctccgaaaatccggatgcgcgtaatcgatgccggaatcaatgaccgccacaaggacaccggcacccgacaggccggttctctcctgcagctgcgtaatgcaggatgcacgctttccattgtccaccgcgaaaaataaaagtttcggcttttccatgtactcgattttatccagcgctgccaccggctccacgagatgttccggcagcactaaaacggcatattcattctgcagatttgtcagtcgaatcctcggatattcctccggaaaatttttaaaaaggagcgcctcaagctcctccgttgtcccgacaaattttacaatgacctcccacgtctgttcggcactatcgtagccgatgtccagctccagcgacttctcccgctcctcctgtgtcgccgccagtgccagattcagcagattctccattttttcgttcggcataaaaaatctccgcaacaacatcttatttctattagatgccgccgcggagaccgttatgtctgcctgtattctgtttttgtctgttttttatttcacccgctcagaaaacatcataaagaagctgaccagaagacatcccaccgacacccagatcatgtgaataccgtagcgcatggacagattgccgccgatgcccgccccgatcgcaaagaaaagaatgattccgaaatagtagagcgactgtcttaactgttccggtctcttgtcccgcagatacatggaaaatgccgccgtgccgctccgcagattgccaatgcacatcgtgctcgcataggaatagccatttaccttgcggaacgtctgcacctgcatcgcgcaggcaaaagacaccagcaccgtcgccgccatgttgtattcctgcgggataaatcccactgcaaataaaatcacaatctcaagcagcagaattccctgtctccagtgaagccgcttcgcgtatttgaaacgcccctgtatgcgctccgcaaaaaacacgccaaacgcaaacgccagcaacgggaacagatagcgcagtccgtccatccatctgcccaccataaaattctgactcatcagcaccacgttgccggtctgggcattggagaagacctcctccctcgtattataggtataggcatcctgaaatcctccggagaccgccagaaaaatactggtcagaaatgcctctgacatctgaagttcgttctttttctcgttcataagtatctctcaccctttcacattcttctctattatagcggtttacgtgagatgcgcaagtacccgttttctgccggctcataatttccgtttgcgcggcatacactattccagtatctgaatgtgcggcagcctgccggcgcattctcccatgaaaggagtattttatatgtgcggaatctccggtttctgcgacttttctaaaaattttaaaaaggaacccgtcctctgggaacgtattctcaccgacatgcatcacgcgctcgcccaccgcggcagcgacagtttcggcacctatttagacacgcatgtggggctttcccacgccagactcagcatccgcgatattgcgggcggcagtcagcccataatccggcaggatggggaacgcacctgcgcgatcgtctacaatggcgagatctacaacaccgacgaactgctgccgccgcttctcgccgctgggtatactttttccaccacttccgacacggaagtcattctctgcgcctatctgcactatgggagggattttgtcagccgcctgaacggcatttttgcctttgcgatctgggacggcggaaccggtgaactgcttttgtaccgtgaccgtgccggtaccaaaccgctcttctacagcaccccgggcggcacactggtctttggctccgagccaaaagcgctcttctgccacccggatatcacgcccaccatcgatgaaaacagcctgttggagcttctgtccatcggtccggcacgcacacccggcaacggcattttttccggcatgcacgaggttctccccggtcattatcagattttctcccgggagggcacgaagcaggtgtgctactgggatcttaccgccgccccgcacaccgattcctatgaaaaaacggtggagatggtctcttatctggtgcgcgatgccgtaaagcggcagatggtctcggacgtcccggtctgcacctttctctccggcggcatcgactcttccatcgtaaccgcgatcgccgcaggctgcatgcaaaaggacgggcagactctaaatacgttctcttttgattttgcggaaaacgataaatatttccagtcaaacgcctttcagcccgagcgcgatctgccctacgtcaacatcatgctcgcccactgccagacgcaccacacctatctggaatgctcccagagcacgctttatgaggcacttttttcggcggtcgacgccagggatcttcccggcatgaccgatgtggatgcctctctgctctacttctgttctctggtcgccagacacaacaaagtcacactgaccggagaatgtgccgatgaaatcttcggcggctatccctggttctaccgcccggagcttttaaaccgtgacggttttccgtggtctgccgatgtctctgcgcgcgccgcattcctgtccggcgacgtgactgaccgcctggatctcgccggttactcgcgcgcccgctatgaagagactataagtgcttccccgaagcttcccggcgaatcgcccgaggaagcccgcaggcgtgccgtcggctacctgaatatcaagtggttcatgcagacgctcctcgaccgcatggaccgcaccagcatgtactccggtctggaagcgcgcgttccctttgctgaccaccgcatcatggagtacgtcttcaacgtgccgtggagcatgaagtatcagaacggcgtggaaaaaacgctgctgcgcgacgcctgcgcggatctgcttccggcagaactgctgcaccgcaaaaaaagcccgtacccgaagacttaccacccgggctacgagaagcttctcgcggatcacctgcgccggatcataagcgatccgaacgcgccggtctacccgctgatcgatccaaaaaaagccaaggcattcctcgccgctcccaaggagcttggcagaccgtggttcggtcagctcatggcgggaccccagcttatggcatattttatccagctcaatgactggatgggaaaatatcatctgtccgtgtaaggaaaagaaaacgcctccagaatcgtgtcctcctaatatgcgcaaagcagatactacagtggattttcttccgcccggcggtgaatctggaaccgaagtgatatcggagccaatctgcaccatatccgcaggagacagaacaaaattattcacattgaaattctgctggatgcgctccgcgtgaactgacttcggaatcgccacaatcctctcctgccgcaaggagtgctgttggcagagcggtcggggcagctttcctgctgcgcctcgccgaccgctttttcagtgggatattccgttagctggagaacgagcaaaactgaaatcttccgtttccagacttgtttgtatcctttttcccgaattgggaaacctcgttcctacacttcatatggcttccgtctatgccctgctttccgagtttccaagtgcagacacagttgcgaatgctcatcttaatggaagaattttttgtcttaatggactgcttggattcctttaatgctgcccgatactgcctgaacattcccttctttgctttatcaacctttttgattttcaattttctcaccttctttcaaatgccaacaaaaaaagccgccatgaagatgtactctccataacggcttagttaaatgttattttttccttttgtggctcttgggattaagcctcatttcttttgccattcttatttcttcttccccaagcttacattttctttttgcttcgtcccaaagttgctggctgtatgccatgaaatcacatcctttcaagattttcttcttgacaaacaatacatatacctttactataggtgttaggaagaaacgaagtttactaccgtacagctattgctcatgcggcttgctcgtttctttttttgttcttaccaaatcatatagataaagttttccatctgcatcacatcttacaagcattcttgttgaaaaaatgttataacgctccagatttccatcttcatcataaaccggtattccaaatcttgtattataacgataccatccaaattgtgcctttgccccatgtttattcttataatcaggatactgtgccttttcagaagcaatctggataagttcaccaatagcaggcgtaatgtttgctttcgctttcatattagcaccttttaatccctttgtatcatttgaatgactgaactcatctggaaaatcagaaccgatatatattttctctgaggtttcggatatttcaaagtattctccaatatattctttcagatactgctctacttcattccaatctatccccttcctcgacttaaatcttatatcattaataagggctatttttgaaccatccaaatccgtaataatactgacacttttgttcatatttctcgtccttttctcttcgtatcagatatctttcgacatctgatgcgattttaccataagtgtcacaattatactatgaatttttctgcttctccttcgctttctgttcttggattatttcgtgtaaatttgtgttgcatcaatctgataactaagatttgtcaaggttccctgacaaccagcaactgcacttttggcacaatccggaatagccgctaaattttcttccaaatattttgctttttctgggtcattcatgcacttctttaaaaatgcacttgatacagataccgttgttgggatcctgtgattgccataatcttaccttcctatctgtttttactttgtctgactagtttctttctgaactttatcagtgtttttcttccaacaactaaatcaatattgctccttttcaacgcttctatgccaacgcatcaaatgacgatgttccgctttccatcactcctatagatgttgaagtacctagcagttccaccagttttcctgtcagatctgccacatctttgccatctattctcagattatattgccgttcttcctgctcctgtttttcggcacgctgtttttccagccgttcttctgtctctttcttttctgcttttcttttttcaagtctttcttcaagttctttccttgctttttctgttcctggatcagcctcatcctgagtacacattacagaactcatgctatcatatccatttatagtaatactataactcagtatctttgctcctcttgctgccacataagcttctgactgttctattgtttttggtattagcgataaattgtactccagccattgttttgtcttttcatctcccataacctctgacaaaagagagctgtttatatttacggaataatctttgcttcttaagcaatcatatttttgtgttaaatagttcttatattcatgggcattcttatatgttctgcccgttttgctgccagcattttgtgtgttgctataacgattcgtgtttgcagcataggtaacacctgtatcattttgaatcttcattatcctattatcctttccctgaaattttatttatctgttttttatatcgccctttcttcatttattatctactcaaatgtaacgaaccgaccttttttttgtaataaaaaaatcagcagacatatttcccactgattttgtaatcgtcatgctttctggtcgaaataaccattatacttccttatctatcttacctgacgttagagaggaatccgttttcaaatatgtaccattgtttgtataagtcacacttgcgcggtttgcagcatttgatataccagctgctttctgggctgttttgcctgcaaaggaattgtaacctgtaaaaaccgttttcaatgaactgatatctgctttcttcaatgcatcttcatccagctccagcttattcccctttcctatggtaatacctattttagaaagtaaatgactggttttgtctgtcatgcctgtcatccatgaagcatttctgaggacatcttttgtattggattctcctgcctccttaacaacgtcattataatcatcaataaaagctttcacttttttggtaattgcatcccagtcataatcctctacctctgtttcttccccggtcttttcatccttctttttaattttctttttttcccagagtgacgcatcgtttagtgcatctgctgattttttcagggaatccgcacttgttttcatcagtgtaagcttctgtgaagtatcgcctttccccgataatttttctgcatcctgctttgcataatatgctttcataagttttccatagcttccgtttttaattgcagcataatcagaaagcatattggtgtttcctacggatgaactgtcggaagttccgccaaataatgcggaataatctacattgctgttatatttacttgtgtaatcactaaaactcttaatctctgacataatcccattctcctttaccaactataagcgaatatcaatcggtgtatatactgcctgttgtgttgcattctgtgcattttccggagtcggtgtttctactgtcacctgtgtttcccttttgatatccgtattctttacgctgtctgtctcctctgctgctcctgtagctttctgtgttttctcagatttttcagtattattctttgttgctgtgccttctgtattgctgttatccgcttttgtagcttcttctactgatttatttgcatcagcaagtgtagacatctgtgctgctgtcgcagactgtgcctttgccttaagctctgccagttcttcttccttcttctcggtatttccttttccggcatcctgtttgatttcagattcaagcacactggcacgtccttctatctgtgttgccatactgccctgcacctttgcctgtttcatggaagaatctgcggagatcattgcctgcatacttgccttggacaatccggtgcctttctttttcgaagtgttatttgttccagccaccatatcatccatagatgacgaatttttactctgctgttcctttctctgctcgatctggtgctgtcttaactgctgattgagattgttaatctcctgctgtatctcctgacgctttttcatcttatcctctaatgacatttcttcattcgatgataagtcctgtagcttctgtttggcatttgcaatctgattctgaatatttttacttacagaatcattcccctgtgccattcccattgtccctgactgcatatttgtcccactaaatccattaattctcatttaatcctccttgttttgcggagcaaaatccgaacccactggtgaggagaggatttagactccttgttttgcggagcaaaatccgaacccactggtgaggagaggatttagactccttgttttgcggagcaaaatccgaacccactggtgaggagaggatttagactccttgttttgcggagcaaaatccgaacccactggtgaggagaggatttagactccttgaacttaaattctgaaatccgtttccttaaaaatctgtacaacatgatttctctttactgattccttcggcacatctttcttcacaataaacagcgatgttgtgaaccgccctttttttgttgtgaagcaaataaaaagcactaacttcttattgttagtgcctttcctgaaatactacttctttttattctacctgtaacataatacttagaaccacttcctgattctcctgctctaaagagatatctcccagatacatccttgcaacccttcggatattatgcagtccaattccatgctccttcccggatttctttgtttccggcagatcgctttccttatattttaatgtgccctcgtaactgttttttatagttatcataaaaatactgtttttccgaaaagacgtaatactgatataaggattttcaccactaacattctccatacaattgttaagtgcattgttcaaaatcacgctcaaatcaaatgcatttaatttcgtatccttcggataatgaaaatctgatgtaaaacgaatctgcctctccttcgcttctcttaacttttccatgaaaatcacatcaaggacaggactccccgtttttatctcaggagatatttcattccactcctttttcaaatgctccatatattctgctgcatcatccatatggttctctgccacaagatgttccagtatctgtatatgattccccatgtcatgacgcaggctgcggatatcctgatacagcttttccacttccccgatatgctttttcatatcactgacctgatttaataccagttcctgccctgtctgttcttcctgtgccaccttccagttttgaaacatgattgtcataacaagaattgctatgatagagataaaataatgcacgaagcttaaagctccataaaatccatacgtatcaatcaggctctttcctgtatccttttcataaatattcagataatattgcagaataccatatcctgttacacctacgagagaaggcatgatgagcattaccagctctttgccgctcatctcatcttttttgtatacataggctttattgatcagaccgattgcgactgcaaggaaaacgatgcagagcacaatatccagaattcttgttccagcataaagtccatattgcagccattgtcttccggcaatcgtattcccaaaaaccagagcttttgtgataaaatcatccagtctgcctgccattgcaaccgcaagccaacggatagaaaagaatgtcactgcaagaaatagtttctgatagatgtttcgtctgtcctgtacatacatcacaagaaatgcagccacaactcccatcaaatatgcagaaaaattgccaatccgctgcggtatcagatacagcacagacataattccaatataaacaatactgaccagagcagcttcccttttctttttcatatatgggtatacaaaaacaccaaaacagattcctgtaaaaatcaaaattgcaataacagaaaacttcgatgtgatcatccagcatctttccacgaaactcatctgacttcatttcctttcctctggttgtatttcagatacctcctgacaaactccggatagttctgttttgcaatcaatgcagttccatttttcatagtcacacaagttgcatcatatttttctacatatttaaaatgtacaaggtatgctctgtgtgttcggaagaaatcttccccagccatattctgcaaatcctgcagctttccgtagtattcaatatccgtatttcgtgtatggataataactttccggttaaacacctcagcatacacaatatcacgcaggaaaatttttatatggcttccggcggtctgtaccatgatatatttttcgtctttttcaagtctggaactcctttttacggcatggactgcctttgtcacaacctctttcaatttttcatcgtaaaatggcttcaccagataatgaaatgctccgacatcaaatgcctgaaaaacatactcctctgctgctgtcacaaaaatgagtatcatatcctcattgtcctgccgaagcatctttgccgtttccattccatccattcccggcatctgaatatccagaaatagaacatccggcttacagccacttgcaatcagtttctcacccgataaatatttctctataaccgcatccggcaataacttttttattttttcctccaatatctgaaccatagatacttcatcatcgcagatagcaattcgcatattgtcacttcctttttgtctgataaatatatttattatatcggacaaacagatggtctctgacacagttgttgtgaaatgacttttttttgttgtgaaaagggcagcaacccattattggttcactgccctgtcttctaatcatgtctgcaatattaaagaaatgaagcaaactcattcattggtatacgctgggattcatgtctatttgcatctgctttctcctctgtataaccaagcgccaatatattgattggttcaagtcccgacggaagatgaaattcctcttttatcacatctggtttaaaataacaaatccagacagaacccaaaccctgctctgtagctgtaagcatcatatgatcggtaataattgacgcatctatatctgttgttttcattccatcaaatgggcgcgtccatgctttattcgtgtctgcacacacgatgattgcaactggcgcattataaatgttagctgcctttgccagtttttccttcgcttcatcactttttacgatcaatagtctcacaggctgcatatttgctgcggttggtgctacatgagctgctttcaaaattgtctccaatgtttcctgtgaaatttctttatccagatagcttcttactgaaaaacgccgcttagcaatatctaaaatactcatttctgtaaaatctccttaaaattatgattgtattgtctagacaatttgattataatggattcgatataaaaaagacaagaacgtacttttttgtaatatactaaccaaaaagaaagtgtaaaacataaaatgcaaaatgtatataattgtcctgttgacgcaacaatctcaaaaattggaggcaaatataaagccgtaatcttatatcatcttggtagcgacacattgcggtataaccagattcggaaaaaaatcccagctatcacagacaaaatgcttgcccaacagttacgcgagcttgaaagtgataacttaatcatcaaaaaaatatatcctgtcattcctcccaaaacagaatacagcttaagtgaattgggcaagacactgattcctttattggactctatgtgcgaatggggacagcaatttatgcctgatgattaagaacccactgcaagagaccgtttcaagttttgtgtaaactacaaaagctgatataagatttgtgaatagttgcaaatgggcagagccgattttccaggttctgcccatatctgcattatacaggagtttttgggcatggcaataagacctgcctaaaacaagcttgttttacaggtttcgtccagccagacgttcttcaaaatagatctcaagctgggaatggatctgtccccagtcctgccggtgtcctgtccatttcttggtgatatccatagtcgcaagatacagcatttttaaaaggctgtcatccgatggaaaaacggtcttgcttttggttactttccgaagctgacggttgaagccttcaatcgcattggtggtataaatcagccgccttactgcctccgggtacttgaaatatgtggataatgtagcccagttatcatgccaggatttatagatcttggggtacttggaatcccatttatctttgaataattccaattcatttaatgccgtttcttccgttggagctgcatatacaagcttcagatcagccatcagttttttgatatctttgtaggaaacaaacttcgttgaattacggatctgatgaatgatacactgctggatttctgtttttggataaacagcttcaattgcttgtggaaatccatttagtccatccacacatgcaatcaggatatcctcaactccgcggttctttagtccattcatgatggagagccagaacttggcgctttcgttttctccaacatacataccaagaacgtccttttttccgttcatatcgatgccaagagcaatgtagactgcacgttttacaatgcgtccttcacttcggacatgatagtggatagcatccataaatacgacagcgtacacttcttccaacggacgttccttccattcttttacaattggaaggattttatccgtaatccggctgatggtactgtcagaaatatcaatatcatacagttcccgcatgtgagattcgatatctccggtagtcattccctttgcatacatggaaaggattttttcttccatgtcctgagtcacagtattctgatattttttgattagctgaggctcatactcaccgttacgatctcttggagtagctacatccatatctccatagcttgtgtgcatagttttgctagaatgcccattccgactgttatctgtttctttgtttcgatagtcatacttggaataacctaattcctcatccaattcctcatccaaagcaccttccagaagaacagacatcatgtcacgcatgatactgtttacatcggtgccgtctttgatgctgatatcattattcttcagataatcacgcatcatttctcgcattgctgctttttgtgggctgtcttttcttcttgccataaaaataacctccaaactgagtaattttatcttacatcagtttggaggtttacacaaactttgggatgctcccatatacacatgcatcctgtcattctataacacagcttgaacttctggcacttcttccaaatcggcgctttgccgggataacatcggcggggtgacatgaagctgctccgccgcccgtgtaatattctcctcccgcgcgatcgcaaggaagtcattcagcgctcgaagttccatattgatcccttctgcccggtttttctccggtagacggcacagaccagatatgcgattaccgctccgatcagcgctcctcccagtacgtccgtcggaaaatgtacgccgacatacagtcttgagaatgcaatcacaaacgcaaacaccagcaccggaacgccgatcttcctcggacccatgagaaatacgacgactgccaccgcaaatgcactccccgtatgcccggatgggaacgagtaatcgctctgcgcctctatgatcctgtgcagcccatccacgacctcgtagggtctcgtcctcgccaccagattcttcagcagtacgttgttcacaagcgtattgagcagcagtgaacaggtcatcaatccgccgaccttcctggtcttccgcagcagaaggaacagaatcgtcagcgcaatccaaaaataaccgtggtcgcccagatgtgtgagaaacgtgagtaccggcgtgaggaaatcattccgcatatgctcctgaatccacagaagcaccggtccttcccagtcaatcaaaaattgttccattgttatgtatcccctctttttctcttttgaggattcttattatagcacccgtctgcgccgcttacaagtgcgtttctttttgtgccttgcgccatcaccggacgtgctatctctgtgcggtcagcaccttattcaaaagatctgccaaaggcaccatcgcattcatcgcctcactcaccgtattggtctgcgctcccacctcaatcagcagtgttttcggacagtagtgcatattgtagcggtaccccttcaggtagatccttcgggtaaatcccggataatactccgccgcctttagctgcatctgaaacgagattgccagattatccgcaatataaggattgtagaggtaatcaatatcccccatcgccgtcgtcctgctcagcccgttaaaaaacatgacctgcgccatctgtattccgttgacctgcgtaaccagtcttgtactctccgccacgccgtcgcggtgcagatcaatgacaacctccaccccgggattttccgcaagcaccgcctcaagccccggtcctgccttggaataggcgtgatccctgtcccccacatcgtattctcccttgtggtgaatcacattgaatccatactgctctgtcaaaagctttgtcaggtaatccccgacaccgaccaccgacgtcgatgcatcccccggaacagaatctgcgtagccctcctgcgagtgcgtgtgatagatcaggatctgcggcgtcgatgcatcgtgtgacaggcgcagatcttttcccagcagtgcatcggcattcagctggctgctgttgattgtcgttgtgctgtccacctgataaaaattctgaatcagatagtcaaaatcattcagtttttcccgcggatataccaccaccttttctgtagccaatgccgtctgtatctgtgccgcctgtgctgtctgtgtctgtgccgcctgtgccgcctgtgtctccgcctgctgttccatctgtgcttccgcctgtgccgtctgtgcttccgcctgctgtccctccgcagcttccggtacggttccctgcgtctgctccttcgtctctccctcccgcatgcttgtactgctttgctccgccgcctcctgcgtcatgatgacttcccccgtcgccgcatccacatagttctcgtccgccgcctcccgcgccagaatagcctcgtaggaccagtcactctccacctgcgtctgataatcggcagatacaccactctcttccgggagcaaaaaaaagtgcgcgagaagccggtctgcaatcgtaagctccgccgtcccctgcgcctgcccgcaagcctgcggcaggaaaaatcccatgatctcctcctgcagcaaaaaccccagttctcccggttccagtcttacgccgccggataatatcactgccgccgccacaatcagtatggttaccggaaggattcgtctccgcttttttctcttatcatgacttctattataatttttatactggtatcgataaacatgcataatttactttatgcaccggcaatttcttttatgccgccaatctgccctccttaaagcgcatgcaggcacccgcccgcaaaagcgagattcagcccttccgagatggtgtagcagagtctcttgaccgactcgtcaatatccttcggcgtcacaaacatggcatttaaattcggcgacagcagttcgcggatgagttcatatttttccgcatcatttaatttttctaatgaatttcccatcgctgcaaacgcctggctctgtgtgagcgcggtaaccagattgtacatcgtatcgttcacgattgtcgcggcatcgaccacggtcggtacgccaatggaaatgaccggaacgccaagacttttttcatccagcgcatgtctgtgatttcccactccgcttcccggattgataccggtatccgtcacctggatcgtacggttcagccgtttcgtgctcctcgctgccagcgcatccaccgcgaccaccagatccggctttgtctcctttacaatgctgtgaatgatctcctgcgtctccatgccggtctgcgccatcacgcccggcacaatgctgctgatccggttcaccgtctgtttgccaaatgcatattttccatactctttcacaacatgccgcgtgataaacagattgtccaccactccaggtcccagtgcatctggcgtcacctcacgattcccaagtccggcaatcagcaccgagaggctctccttttgtaaccgcacaagctgtctgatcacccgcgcaagctgttcggatacctctctgtggtagtccttgtcctcctcatccatatctgccgcctcgatggtgatgtatgttcccttgggttttcccattgtctttgccccgttctccgtctcgatcacaaccgtgctgaccgtcaggttcgggctgagtttttcctccaggaaacggactcccttaagttccacatgatcttcctgcattttttcctgtgtctccaatgcaagatcggtgcgtatctgatacatagtctcctccattttttgtattcctgcagacaggacatttctttctgtctagtctgccacagaaaaaaaaagttatccgcaaatttttctgacaaatttcagcattttctcttgacaggtcactcaaaagagcctatactatcatagtatgtttacattgaactgtccgtgtccggcttcgatgtacatttcattgtaacgatgcactgcatgtgccgttaccagttagaatcataatcataacaaattggaggtgtacagattggctaacattaaatctgctaagaagagaattttagtaacagagacaagagctgcaagaaacaaatctatcagaagtgaagtaaagacagcaatcaagaaagttgaggctgctgttgctgctaacgataaggaagctgctaaggctgcccttacagtagctatttccacaattgagagcgcttcttccaagggcgtatatcacaagaacaacgctggtagaaaagtttcccgtttaacaaagcttgttaacacgctggcttaattccagagaatagatcttaacatacggtcctaacccaaccgtatgaaaaacaccagtaccgtcatactggtgtttttttattttttctgctttgccgcactgtagcggatgataaacagctccactgccatctgatcgttcatccgtcccgtctttaccgcttcctccagcgccacaccgtcctccaacgcctgtctcaactgccctgcgccaaaaccgcgcgcctgggtgagattccgctttacggcaaacggcggaatccccgccttctgtgccatcgtctgattgtcaaatcccttgcccgccatatcccgcagatgaagcagaatctggaactgtctggtaatcagatacatgatacgcatcggcggttccttgagtgtcagaaggtcataatacagatcgagcgccctgcgctggttgtgttccgcgatcgcattgaccatctcaaaaatgcggttcgtcgtctgctctgtcgcaatcgcttccacatccgcagcctcaatgacacttttgtccatggtataacagatcagcttttccagttcccggtcgatattgcccatatccgatcccgtcttactcaaaaaaagctgcatcaccgatcccgtaatattctttccctcttttttcaggcgcgccagcacccagcgcgtaatcagttcttccgtctgggtggcgaattccactatttttccggcgttcttcactgccttgtacatcctggaacgcttgtccacttcctcctccacaaacacgaaataggtgcttgcagcgggctgtgccagatactccgccagttcatcgcaggcatttttgaaaaaaccgctgttctcgataagaatgactctgcgctccgcaaaaaacggaagggtctccgcaagatcaataacctgcttcgggttgatgtcctttccctcgaagcggttaaaattcatatcgccgtctccgcccgacagcatgccgcccatcccggaatcctctcccgccgcagtgagcgcattctttaacttgtcccggtactggcgtttcaaataatcttccgttccatataataaatagatctgttttaaatttccggatctgatatcttcgtcaattgttttcataaaagtttctgtcctgttcttcctgtcttaaatagtttcagccgctccggcatcatatacatattatgctccggcaaaagtccgggcgtagcgcgttctgctgatctcgcagtgcacgtccaagaaatccctgatttcttggactgacgggcattcgccctatcattcgtcaaaaatatccgatgcattgtgcaagcactgcatcggatattttctccttatggcactgctcattgcttacgcacattatatcatacctttaccagtgccgcaaacttccctcactgccaccactgttctttttcctccagatacccctgacagacggcttgtccgtccgtctttttgacgcacagtctgccgctttccatcgtataatacacctggctccccgcctgctgcatatgcccgacagcctccttggaggggtgtccgtaccggtttgttctgctgcacgacaccagtgcgatctccggtgccagcgcctccagaaacccggtggaattggaatagcgcgatccgtgatgcgccgccttataaaaatcgattttctgcacgtcagctcccgtttttgtcttctgcagccaggtcagaatctcctcttcctgcgtcgctccgatatctccggtaaagacaccggcaaagtcatcctcctgataaaaaagcaccagcgactcctcgtttttgtccacagactgacccccaaacgcgtcctcagattcaccgggatgcagtgccgtaaacgttgcgtttccaaaatgccagatgtcgccccgcctcagccacaccacttttgttcccgcatcctctgccaacgcttccagttcctcccagttttcatcccgcggcatctgttccgccactgccagatactccacgggatatcccgacgacagtatctcccgcagtccgctgatgtggtcttcatcggtatgagacaccacccagcagtcaatctttttgacccctttgtactttagaaacggcagaatccgataagtgcccacctttccgacattggaacttcctccgtccacaaacaggtggtacccctccttcgtctgcagatagcaggcgtccccctgcccgacatccagcatatccagttccgcctccccgctccgcgaaactcccaatacggcaagcagcaatagtgcggcaaggaaaacgcccggatgtcctccattcttttgctctgccctcctgccgtgttccttttctctttccctttgctctctctgccggtgcaataagcatgttccaactcccagaaacgcataatataccgcgatctgccagcgctgcggtcttccgacaatccacatggcgcccggaagcataccggcaagcgcacatatatgcttccccataaagagcagaattctgcatggaaaaagcatcccttttgccaatggaagcgacaggagtcccaccattccgcctgccgctccgaatccgagcagcacccccatcatcggtagcatgagcaggttgacgaaaaccgcatagaccggaatctcataaaaataccatgccacaagcggcagtgtcgtaaaccagaccgctgatgccgcaaagatttttccgcgcagcgctcccatcccttttttctcataagagatgctctgaccgacccacacgacgccaaggattgcaacaaaggaaaagcggaatccggcgtcccagaacaggcagggatttttccagagaagcgccactgcggcaaatgcgagcgcacaaaatgtatcatagctcctcccgatgacctgtgctcccagaaacagcaggaacatgagaaccgcgcgtctcacggaaacgccccatccagccatcccgccgtatccgtacatcactcctgccgctgcaagggcagccatgccaaacggcagtcccgctttctttaacatccggtagagcgccatcccgatcacagagatatgaagtccggaaatcgccagaatgtgcgacaatcccccgatctggtagagtctcttcgtctctgcatccaaaaactccctatcgccgacgaccatcgtcgccagtatccccgcatcgcgctcgcccatcgtcttaaggtagacctctttaatccgctggccaagctgccagagggcttccgccgtctgcctctttgcacacacctttctatcaagtgccgaaccttccatcgcaaaatcaaatccgcgcgcaaaataataagccttcgcatcaaacgcaccctcatttgatgcccgcttccataatgtaatctctccgtgatatatgagaatatctccgatggaacaatcatcggaatcagaatagatcagaaccccaccgcacgataccggttctgcctgtaagaaatttgatgaatccgtccgaaacatacaggacgttaattcatagacatatcgatttttctgtacctgttttcccgcaagctgtccctgtacggtcacatacatgccatcctgcagttctcccagatacgcctgcctgctctcctccgcctccaaatatcttccgcttccaagagcaaacatcagcaaaaaaactccggcgccaaaagccgttctctttctttccgacggggaaatcccgtcgcccggacggtacccgtcagcaaaaatgccgccaagaattccgcaggccaggacgccgcaggctagcaatgcccgcgcgaatacgctccagccgtatgccgccgcaagaatccccgacagaacgcccgctgcgccaagacacaaaggccgttttgtcacacacttccccctttaatccgtttcggtaggttcctccgtttccgaaaaggcgctctctgcccccgtgacataatccatattgcggtcatacatatccgcgagcgggaaattgtcgcggtagactccgctcgtatcgccgttgacggaaatctgaaccttgctgatcgtggaaagctccgacagggaatccacgatcgaatagataacgattgcctcgtttactttgtaatcctgattcttgaacgcttcatccaggctgacgtagcagacgccgtccaccaccgacacagagacaagcttggttccctccggaatcgcagactttgcatccttggtcttcggaccgtctaaaagctgctccataatcagtttttccatggaaatattgctgctgtagtagacatcctcgcgcacttccttgaccagaccgtccccgtccagattggaaaaatacagcgtgagtgttgtattctgaatggaattgatctgctctcccggattttcgataaagctgtcctgattcatggtaccgacaagattccccttcgcatccgtaagcggtgcgtctccaatgtaaaatgccacgcagtccaccccgtcgatctgtgtcatcgtccggacaaccgccgctcggcacagtacctcatcgacagcactcattttgctgtaatcctcatcaaaatgcagggttaaaagcacaccgtccagtgaataattcgtgatttccacatcatttggaatcggcttccggtaatccacattgtccgaatccgaactcagtttcgcaaggaactccttgatcattccgtcggtatcggttgccgaaggctcataaggttcttccaccagacggttcttgtccttattcagatattcgatatgataggcactctgctccgtctgcctgccacacgccgcgagcgagcctgacaggaacatcagacatgccagtcccagacatattaacttttttctccatcgataagcttctcggctcatagactctcccttatctaagaaatataattcagcggaattctgacgttgaaaatcgttccctctcccacggtactgaacaccttgatggctccgcggtgcatcagaaccgcgctcctcgtaatggcaagtccaagtcccgttccgccaatctccctggaatgagacttgtccacacggtaaaaacgctcataaatatgctctaacgactcctccggaataccgattccgcaatcctccactttcagataaaaatactggtgatcggcattcaaagagacatgtacccatccgtccgggcggttatatttgactgcattttcgatcaggttggtaaaggcaagcgtaatctttacctcatccacatccgcactgaccggtcggaaactctccaacaccagctcgatattctgcttttccgcaatcggctttaagcgctttaaaatctgctctaacagttcgttgatgttgacattcgtgatgtttaaatctcccgcagacttatccatctttaccagagacagcagatcattgatgatcttcgtctcacggtccacctcgttgccgatatccgacatgaattcctgatacagctccaccggtgcgtcctccatgctgttgatggaatccgccagcaccttcatggaagtcagcggcgttttcagctcatgcgagacattggacacaaattcctgtctcgaatcatccaacaccttcatgcgccccaacatcttattgaacttttcacagatctgcctggtctcggtgtaagcgttaatctttaatgcgtcatccccatatcccgtctgaatctcctcgatcgactttgccatggcatggaacggcgccacaagatgaatcgcgataaacgttcccgcaaagatgatcgccacgatcgcaatcagttccatgacaagcgtattgcgcgccagatattccagattcagattgatgctgtcggtcgaaacgctcaccataatcacaccgatcgtccgcttgttctccgtctccgggtccacatgcaccaacggaatcgtcatttcaatgtaacggttctgggaatcatatttgctgatttcctccccctggatactcttgatcacttcctcggaaataatcgtctttccggtgtcaagattgtaggtatcctttatgatatggaactcctcatcgataatcatgacacgcccgtcatagatcgttgacagctgctctaactgcacgttgatcgcagactcactctccgcattattcagataatcattggaaacgatctgattggcgagaatcttcgcctggcttagaatctcactcgtgcggatcgacaccgcacgattttcataagagccgagcatcccggcacgcagcaggacgctcggtacaattccgatcagaatgcagagaagaatcagtctgcacttaagacttttgagaaaatcggttaattttttaaatttagacattgtgtacacccgttaattctgtgaataatagtacccgacgccccactttgtgtgaacgtatttcggttcgctcggattgctctcgatcttctcccgaagacgccgcacatgcacatccaccgttctgacatcccccggatactcatagccccatacaagattcaaaagattctctcttccatataccttgttgggattattcacgagcagttctaaaaggtcgaactcctttgcagtgagattgacctccctgccgagaataaacagccttctgctctcgcagtccagctttaagtctcccgcctcgatcaccttggattcttctttcctggactgcgatgcggcagttcttctcatgatggctttgattctcgccttcacttccagaatgttgaacggctttgtgatatagtcatccgcgccgtactccagtccaagaatcttatccatgtcatcgcccttggctgtgagcatgacaatcggcatattggaaaactcgcggatatgctggcacacctcgaatccgtccatcttcggcagcataatatccagcagaatcatgtcgtatgcattctctgtcgccatcttaagcgcttccttaccgtcgtaggcgcaatccacttccatgccgtcctgctccagactgaaacggattccctttacgattaacttttcatcatccaccacaagaacttttttcgccatttatttcacctttatctgatctctgatccgattatacaatccctctttgattccatctacattcataatctcttcaacggaagaaaatcctccgtgcgcatcccggtagtttacaaccgccttcgccttggtctgtccgatcccggaaagcgtcataagctctgccagcgacgccgtgttgagattcagacgtccgtcttccggagacgatgccgtccctcccgaagttccctcaccgttcctgacactgctgtccgcagaagtcacacttcctcccgcagaaactgcactgccgcccgcagaagtcatactgcccgtcatcccggccgcttcttcgctgtcaggaatatacaccatgagtccgtcgtacacgctctccgcaagattgactgcacacatcccggcatcctctgtcatgccgcccgccatctcgaccgcctcatagatgcggtctccgggctctaacacgtacacgcccggctctgccacctctccgcagacatagacataacattttcccgacgcacggtctgccttatcagcatcttccgtcgtctccggtgcaagagctgcctcagccgcccattcctcaccggaaacctccggcagatccacacttcccgtctgctccccgccggaaacgtccagtatatccagacgctccccagcctccgtttcttccgtctcctgcacattcccggtatcctgcgagacttccgtctccagataaacctcgttctgactgccacatcccgccataaaaatgcacagaatcatgccagcccctatcttcttccatgttcgtatcataagcattctccttcttctatataaaaggagtcctcaatgcccgatattcatattctaacgaaattttacagccgtgacaagagtgtttcagaaatatttcaaaattgtttcttccaatgttacccagaaatttttggcatccttggaatccggcattaaaactgccccctcatacgcgtccaacgccgtctgctccacggtatccggcgtctctgacggaatcacggagtaatgtcccgacaatccatgcaattcgtccgccatgccgactgtcacaaactgtgcaaaatctgccgccgctgcactgtcttttgtataatcattgaccactatcatatcggtagacgcacatgtcgccgccgagagcgtatcgcttaactccggcatctgcatcagcccatagtcatatccgtccagctgccagagtgtatcagtatccaggattgccgaaagagtccgcccttcccggaaattgttcacgatatgctgttcggacacctgatccgcatcaatggaaaaagatgccaatatcgtgtcaaaatactccagatccagctgatagagcgtatcatcgtaggtgacatccaattcgtccgatcctctctttgcgaacgtgacgctgttgccgacaaacgggaaatcatagaacgcatccttgacatcccactccagcagatattccacattctctgccggctcgttctcattggaataatcgatgattgcctgcagtgatgccggcgcctcggtaaaataatccgtctggtaaataaacacgcacgcatcgtaggacagcggatacccgagcacgcgctcttcgtaggtcgccgcctcgactgccttttccaacacgccgttttccgacggatccgtctgattcacggaaacaagaccatagaggtatgcttcctccagattatcccccggtaagaggtacacatccggaaatgcatcatcctgcatggtcttatcgtaaatagttccaagataatcaatggtatcctgatactgcacggctacttttttcccggtcttagcgtaatagcgcacagccgcctcggtaaaaaagtctgcatagctgtcatccgcataccacagcgtaaggtctgccggtgcgctccggtaagcttcatccgccgccgtttctcccgtctccgtggaggacacaccctccccactgctgccgcatccagctgtattcataacagccattcctgtcattccaagcacaacgacaagtcctgccaccgtcagtcttttgtataatcgtttcattttatttccctaatccgtttttttattctcattatcagggaattacatctctgccagaaccgcatccagcttctctgccatctcatccacatgctctttcccgataatcagtggaggtacaaaacgaagcacatcggcgcctgccgtgatcacgacaagtccgtgttccaatgctgctgacgcaatttttccaaccggtttctcacacacaacgccctgcatcagtcccagacctctgcgcgccgtaaggaaatcatacttttccacaagcgcatccagcttctgctccagatacggcgtgatctcttttacatgctctgtaatccgatcccgctccatcatcttaagcacggtgtcaactgctgctccgacaaacgggttgccgccgtaggtcgtcccgtgatcgcccggtgccagcgacttttccgccacgcgctcagtcatcaggaatgctcccaccggaacaccgcatccaagcgccttcgcgctggtcataatgtccggtttcacaccgtagtgctgccatgcgaacatctcgccggtgcgccccatgccgcactggatctcatctaagatcagcagaatgtcatgctcatcgcagagtgcacgcaccccctgaaggaattcgtcggttgccgggtagattccaccctcgccctgtaccgtctccaaaataatagcacaggttttctcatttatcaaagcttttacgctgtctaactgattaaattccgcgaaacggattcccgggatcagcggttcaaacggttcctggtaatgtttattgccggttaccgagagtgctccgagacttctgccatggaacgagtgattcatggcaatgatctcatgccctgcatgaccgtccctggtgtacgcgtatttctttgcggcttttaaggctccctcgattgcctccgtgccactgttcgtaaaaaagacgcgatccatccggcttgcctttaagacacgtttcgccgcgcttgtgatcggctcgttgtaaaacaggttggacgtgtgcatcagcttatccacctgcgtctttagcgcctcgctgtactccctgttatgatacccaaatgcctgcacggcgattcccgccgcaaaatccagatattcttttccgtccgtgtcatacaggtatacaccctccccatggtcaaacaccaccgggaaacggttataggtatggaggatgctctcctccgcctctttcatgcatgtctctttattcattgtaatacctcttctctttctcactaaggatcgccgtaccgatacctctgttggtaaagatctcaaggagcagacaatgtgcgatccgcccgtctaaaatatgtactctggacacgccgttttcaatggcgtcgatgcagttgttcagtttcggcagcataccgcccccgataaagccgtcgccgatcaatgctctcgcctcgtcgatggtcagttccgagatgagcgtgctcttgtccgaaggatccttgtatacaccctcaatgtccgtcaaaaatgcaagcttctccgcgctgaccgcctttgcaatcgcacaagccgcatcatccgcgttgatattgtagctgttgtaggcatcatccattccgaccggacacacgatcggcagaaaatccttctccagaagatcgtagaggatcttcggattgacctccgtgatctcaccgacaaatccgatgtcctccccgttggaatattttttctccaccttgagcagtccgccgtccttgccgctgatgccgattgcattgacacccagctcttccaccagcttgaccagagatttgttgaccttatttaagaccatctccgcaatctccatcgtcgcctcatccgtcttgcggagtccgttgacaaacaccggctccatgccgacttttccaacccagcggctgatctccttgcctccgccgtgcacgatgatcggcttgaatccaaccagttttaagagggtcacatcctggatcacatggcgctttaactcctcgtccaccatggcgcttccgccgtactttaccacaatgatcttgcggttaaaacgctgtatataagggagcgcctcgatcagcacttccgcctttgccagaatttcctgcatatttttctcgtccattttctctccactctccctgaatttttacgtctctgcttaggaacggtaatccgcgttgatcttgacataatcatatgtcagatcacagccccacgccgtcgcctcctccgtgcccatcttgatatccgcgatcgccgtcacctccggctccgagaggatcttcgtcgcctcctcctcgctgtagtcaagtgccacgccgtcctttatgatctgcatttttcctgccgcactctcaaagaacagatccaccttctccggatcaaactgtgcgcccgagtaacccatcgcacagagaattcttccccagtttgcatcgtgtccgtagattgccgccttggtcagattcgatgtgatgaccgacttgctgatgatcttcgcctgctccttcgtctctgctccgatgaccttcacctcaaacagcgccgtggctccctcgccgtcgcctgccatctgcttcgccagatattcattgactgtccgcaatgcctcgcagaacctgtcgtaatcctcatttttctctgaaatgaccggattctccgccatcccgttcgctaaaagcagacaggtatcattggtggaagtgtcgccgtccacggagatcatattataggtgtcgcagacatctgcctgcagcgcttctaaaagcaggggctgtgcgatcgccgcatccgttgtcacaaaactcaacatcgtgcacatgttcggatgaatcatgcccgagcctttgcacatgccgccgatcgtaacaggaacgccgccaagcatgacttccaccgcaatctccttctcgtgggtatccgtcgtcatgatcgcctgtgccgccgcatgaccgctctctgtctcacccgacaatgccggaaccatcgcctcaattcccgcacagatgcgctccatcggaagctgcatgccgatcactccggtcgatgccacgagcacctgatcttccggaaccggaagcagttcaccgactttctccgccgtctgtctgcagtagcgcattccctcctcgccggtacacgcattggcaatccccgcattgatcacaaccgcctgcgcctttttgctctcgtatacaatcttctgatcccactttaccggggcagccttcaccagattcgtggtaaaagttcccgccaccgcacagggaacctcgctgtagagcattgccatgtcctgtctgttctgatatttgataccagccgccgtgctggcagcacaaaatccttttgcggcggtcactccgccctttatcatctttatcattccgcactccttttcttcctatggattataggtcgtgatattatcctcgtttgtgacatattcgtaatagttgacatcctcgcggaaagtccacccgagtccctgccagaaacggtttccgacttcatttttcttgaatgcaatcaggttgatcttgttgatatgctctgccgcaagcgcatccacgcaggcacccacgagtttctgtccgatcccgtgcttgcggtacgcctcctgcacgcatacatgatacaggcagcctcttctcccgtcatgtccgcagagaatcgcgcccacaatctttccctccgccaccgctaccatgctggtggtcggattacgtcttataaaacgctccacgccctctctggaatcatcgatgctgcggattccaaacccgtgaatctccatccataacgcatgtaccgtctcaaaatcatccattgtcatcacgcggatgaccggttctgtctctttcatacttccatctcttctctttatcatttccggttcattttcccgctgcttccttccgtggaaaatccttcccgggttctgttttcgctctgtatctacgggaacatcggcaccagacaaagcccttccgcctcgtcaaatccaaacagcagattcatgttctgcactgcctgtccggccgcacccttgaccagattgtcaagcgctcccatcatcacgattctgcccgtgcgctcatcgatcttaaaaccgatatccacataattgcttccctcgacccatttggtctccgggcacgcatccttcggaagcacgcggacgaacttttccttcgcataatacttatcgtaagccgccttgatctcctcgtaagaaggaagacttccgtccgcctttttcgtcagggtggcatattctgtcgccagaattccgcggttcatcggcaccagatgcggcgtaaaattcacaacaaccggtctgcctgccgcgtagccgagctgctcttcaatctccggtgtatgtctgtggctcgtgacaccgtacgccttcatattctcattgacctcacagaacagattcggcagcttcgcaccgcgccctgcgccggaggtaccggacttcgcatcaatgataagggtatccggatcgatcagcccttccttcaccagcggatatgccgtcagaatcgaacaggtggtgtagcagcccggattggcaaccagtctggcatttttcactttatcgcggttcacttcgcaaaggccgtacaccgcctccccgataaactgcgggctcttatgctcgatcttataccatttctcatacaccgcaacgtccttgatacggaaatccgcggacagatcgatgatctttgtcttctcaagaagtccttcgtttaagacgcctgccagaaatccctgcggcgtcgccgtaaagatcacatccacctgctctgccagtgcttccatattgtcgtccatacacacgtcatccacgatctcaaacatgttctgatatacttctgcgtatttctgatctatataacttctggaaccgtaccatttgatttccacttctttatgtcccatcagaagacgcaccagctcatttcccgcataaccggtcgcacctatgattcctgcctttatcatgttcgtattccgcctttccttttcctgcaaaaaatcttttcacactatatccctatattagtctacctctttgccatagtaaagtattttttgtccgttttttagaaatattcttgcataattatacatccgttttttcttttatgcaagcattgttttactatttatgcaacgtttttcttgttttagatttcttttttccttaatttatataggttttccctattttcattctgtatgctttgtacatgtatatgcatttttatttgaaatatatgtatattttttcacttgcttttccgttgcatatgttgtatattgattgcagttaatgatttacagaaaggaaaaaagcccatgaaagaaaaagttatcttagcttactccggcggtctggacaccaccgccatcattccctggttaaaggagaattacgattacgaagtcatctgctgctgcatcgactgcggtcaggaggaagaactggacggtctggaagaaagagccatctcctgcggagcttccaagctttacatcgtcgacatcatcgacgagttctgcgatgactacatcatgccgtgcgtacaggcaaacgccatctacgagaacaaatatctgctcggcacttccatggcacgtccgttaatcggcaagaagctggttgagatcgcaagaaaagaaggtgctaccgccatctgccacggcgctaccggaaaaggaaacgaccagatccgttttgagcttgccatcaaggctctcgctccggatctcaagattatcgctgcatggagagacgacaagtggaccatgcagtcccgcgaggatgagatcgcatactgccaggcacacggcattcatcttccgttctccgcagacaccagctacagccgtgaccgcaacatctggcatatcagccacgagggtcttgagctcgaggatcctgcctgtgagccgaactacgatcaccttctggtactcggcgtctccccggaaaaagctcctgaggagggcgagtatgtgaccatgaccttcgagaaaggtgttccgacctccgtcaacggcaagaagatgaaggtttccgatattatccgtgagttgaaccgtctcggcggcaaacacggcgtcggcatcatcgacatcgtggagaaccgtgttgtcggcatgaagtcccgcggtgtctatgagactcctggcggaaccattctgatggaagcacatcagcagctcgaggagctggtacttgaccgtgctaccatggaagtgaaaaaggatatgggcaacaagctcgctcagatcgtatacgagggcaaatggtacacccctctctgcgacgcagtgaaagcatttgtcacctccacacaggaatatgtgaccggtgaagtcaagttcaagctttacaagggcaacatcatcaaggccggaacgacctccccgtattctctctacagcgagtccttggcaagcttcaccaccggcgatctctacgatcaccacgatgcttccggattcatcacactgttcggactgccgttaaaagttcgtgcaatgaagatgcaggaaatcggcgagaaaaacaaatacgaataaatcgtacatccggattgcttacacaagaacccccggaaatctgccgtttcggcagatttccgggggttccttttctgtccggttattcacattccgataattttcttcctgatcatgcgctttcctgcgcatccagtatcgcatccagcacggcaagccccatctggatctcctgctcggtcaggctgccatatccaagcagcagcaccggacattttctgtcactgccattctctttcgtcagcgcatattcgccgagccccgatactttcacgccctgcgcagccgcacgctcacagatctccctctcgctgcatccggtatctgcctccacgagcacatggagtcccgcatggtctccgctgactgagagcacccagcttctttttttcagttcaccgatcaggaaatcatgcctgccgcggtaaataccgcgcatcttattaagatgccgctcaaaatgcccgtcccgcaagaactcccggagaatctcctgctgcatgcgcggcaccgtcgtcgaataaaatccgcagacggcgcggtagcgctccatcagctgctgtggcagcaccatatagctgatacgcagagacggcgcgatgcttttggaaaatgtcccaaggtaaatcacctttccaagtccatccacgctctgcagcgatggaatcggctttccgcggtagcggtactcgctgtcatgatcgtcctcgatcagatagcgctcctcccgctctgccgcccacgcaagaagttcaagtctccttccaagaggcatgacgctgccggtcggaaactgatgtgatggcatcatatagaccagttccggctctacggcgcgcaccgtaccgccgctaagcccctgctcgtccgctggcaccgtcaccacccggtatcccatattccgaaacgtgtggtatgcctgcggatatcctgggttctccatgagcacagtcttatttttcccaagaagctgcgtaagcagaatctccagatactcattaccggctccgagcacaatgttttccgggcggcagttcacacctctggcgtgatgcagatagtccgcaatctcactgcgcaggctgtactccccctgtccgtcccccgccatcagcagttcctcgctgtcatccaacagcacattccggctgatcttccgccagacgttgtacggaaaactgcgggtatcaatcgcatacggggaaaaatcaaccagacagaccggtttttccgctctgtgtacccgtcccgtttctccagcgctgtttccctgaagccggtacagctccgcgatgtcgcatacaaaaaaaccccggcagggttccgcttgtatatatccctctgccaggagctgatcgtatgccatctctacggtgcttctgctcactgcaagattcttcgccagaagacgcgtggacggcagccgttcccctctcggaatcctgccgtctgtaatctcactcttgatgtattcgtatattttctcatagaggggagctttcgctcccccctgtaagttcatcataatctctatcattataaaaccttatccgtcgttatgccttgcttctcttgatctcctcgacaatgcgctccttgagttcatacgcgcggtccttcatcttcttggacgccgctgcggactgcaggattcttgcaatgcacttcgatgcaacatcgtactttttgtagtggtatgccatcgtcgcgagcaggtaatccatcgtgcactcatccatgccgcacatcggataggtctctgtggataccgcctttgtaaatccttcatacgcctgtgcatagaacgcctcttcctgctccctgcactccttgatctgctctgccatcttcggatccttcgcgtctaaagactcacgcttgccgcgcagcagccatgcaagattcaggcaggtgtacgccttctcgctgttctttccttttttcacaatcgtgttgaacagtgccagcttgtagcgctcgatcgcggtatcataatcgatcagcgtcggctccacattgtccgccggcttgaaattcacgcagatcttctccttgatcatcttgacctgcatggaggacaggtgttcaaaatagcgcgtaatcgcggtataaccgcagtacggacaggaaatcacactgtactttaaggtgtcgatgtgctcatagcgcgggcgcagatccatatcggactcaagacgctttaatcttccactcttgatcatctttgtcttaaataccttgtcacacactgcacaacgcacagccttgtccagaagaaagctttcttctgtcggcgccgcctcctgctttgtgccgtcctctcccacgacttctttcttctcttccgcaaaaagattcgtggtatcctctgcctttaaaccaaatttttccaaaccggataataaattcatatctattcctcctaaatctcagaccgcgtcctacgcagttggcagcttgaatgaactcttcagtgacacaatgcggttgaacaccagctgctccggcgtcgaatcctttgcatccacacagaagaatccctggcgtacaaactggaaactgtcgtaagcctttgccccagcaagattctcctccaccatacagttctttaacacagtcagtgaattcggattgaggttcagacttccatcctcattgtatacccctttttcctcgtccacgatattctcatacagtctgaccgttgcaggaaccgcatgtgctgcggatacccagtgaatcgtaccttttacctttctgccatccgggctgttgccgccgcgggacgccggatcgtaagtacaatggatcaccgtcacgttgccgtctgcatccttctcaaagctgttgcaggttacaaaatatgcattcatcaggcgcacttcattgcccgggaacatacggaaatactttttcggtggctcctccatgaagtcttcacgctcgatatagagttctcttgagaacggaatcttacgtgaaccgagcgcctcattctccagattattcacaacgtccagatactcagtctgtccttccggatagttgtcaatcacaaccttcaccggatcaaggactgccatcatacgggacttcttcatcttgagatcctcgcggatgcagtactctaacattgcatagtcaacggaactgtttgcctttgaaataccgcacagttccacgaacatctttaacgattccggtgtaaatcctcttctgcgcagcgctgcgatggataccagacgcggatcatcccatccgtccacaataccttcctcaaccaggcgcttgatgtaacgcttgccggttaccacgttggtcagatacagctttgcaaactcaatctgtctcggcggcatctcatccttatccggaataatctgtgcgcccacctcgttgatgacccactcataaagtggcctgtgatcctcaaactccagcgtacagatggaatgcgtgattccctcgatcgcatcctcgagcggatgtgcaaaatcatacatcggatagatgcaccatttatcgccggttctgtggtgtgtcatatgcgccacacggtaaatgaccggatctctcatattgatgttggaagaactcatatcgatgcgtgcgcggagcactttctcaccatccgcgtactttccttcccgcatctcctcaaacagctttaagttctccttgacacttctgccgctgtacggatcttccttgcccggctccgtcagagttcctcggtactcacggatctgctccgcagacagatcggagacataagcttttccttttttaatcagctctacggcacactcatacatctgatcgaaataatcggatgcgaagaaaagtctgccttcccagtccgcgccaagccacttgatgtcctccgtgatcgcctccacgaactcggtcttctccttggtaggatttgtatcatcaaatctcagattaaactttccgccatacttctgtgccagaccataattcaaaagaatggacttcgcatggccgatatgcagatagccattcggttccggtggaaatctggtatgaacaaccttgcagtgcccttcctcgatgtccttatcaatcatctgctcaataaaattctttgagacattttcgttttccataatgtcgcatcctcctcaattacaatccggacagcctgccgtccgatctgctttccctgtcaaaaaaagagaaagcaactcatgaaatatcatacatgatacaccgtcaaggtgcaagtataatataacatgaattgcctttatttgctaatactattttatttctatgtttttactgatcttccaccagtctatcccacactgtataagcagcatttccacgatgatctgtcaaaccatacctttccttcagaaaagtccccagatattttgataccttcgtggcgccggcttcattcaggtgatctcccccatcaagtgtgtcagacttccagtcgatcccgagttcttctgcatacaaattcagatccagatatagcacatcatgctcctgtgcatattctgttaccgcatcatggcgtgatccgttccagctctgtggagacggaatacttaccagcatcatctgaatgttatttttttcacaaagtctgtgcactgcgtcaagatagctttccggtacaaaagccagaggctcctttgccgattccgtctgcatatagtcaccacctgtgtaaggcactatcgctgtctttttctcatatcccatcgtaaaatcgggcttcggttcctccggctgcctgctccagtctgactcatccatattcttccagcggttgtgatatttataaaacggaagatcacttgcaagctgcagctcgagcgcatgattaagctgatctgccatactgccatccatatagatcagattcgtctctaatacaacaatatccggagactgcttctccagaatctgtttcagccagttatacgcttccggtataatctgaccggactgcccgcacacatacgacgcaatcccctgctcttcccatatctgcaccggttttatcgatgtaaacgtgatactgtctccaaagaaaataacgtccagcgaattgttctctgccccaaagattccgttgacctttacatcacgcggcggcattcccgcctctactgaattatcctttggatagaagacccgtgacaatcccagaaaaatcactgcaagtatcccaaaaaacaaaagataccttactattttcttcactctgttcatctgatcctcctaaaaattcgcatagatcaactccacttccagatatccgtctccgaaggccccaaagataagtggaagcaggatcattacataataacaacaccaacgtgccggtgtcggcagtgtgacaatcttccgccggatagagatcccccgctcatggagcagccccaccacagttaccagtataacaccacacaaaacgatcgcgatatctgccctatcaatcccgaaagacggcagatccatctgtcccaaagccgtcatgtgggaatgtccgaatacggtctttagcataacaatcgcagcttttgccccgtttgcccgaaagatcatctcaccgatcaccaccagcacactggtacgcacgatctgaaaaactgcataccccttacttttcaccagtctgccgcatttttcatagaataccgcaatcagcggttcacaaagaattcctgccataatcagaacgaagtaatacataccgaaaaaaatataattccagtgctgcccgtgccacagtccattgagcagccataccggaaaaagagcagctgcggataccgctactttagcgccatgctttccaaaccgcgccttagctctggttccaagcttctgtacccatccggtaagggataccggataaaaaatatagtctttcagccacgcgccaagtgtgatatgccatctgcgccagaattctgatacattttttgacagaaatggctgcctgaaattttccggcagcacaacaccaaacatctctgccacgccaatcacaatatccatacatcctgaaaattcattgtaaagctgcacggtatatgccactgcggcaagagccagaattgcaccatcatagctctggtaattcaaaaaggcaactcctactgcccgatccagccggtctgcaatcacaatctttttaaataatccccacagtacacgctgcgcacccatggtaagattttcgctgctaattgctgttcccttccacagctgatccgccgtctgatcaaaccggctgatcggtccctccatgatttgtgggaaaaatgccatgtacaacgcaacctttccaaactgtcgttcagccctgttcttcccctcatagatatctaccacatagctgaccgcctgcagtgtgtaaaaggaaatacctatcggctgtagaaaccgaatactcttcaggcagataggcaaggtcagaaggcgaaatactgctgaaagattctccgcgaaaaaattataatacttcacgataaacagtaccccgaccagaagcacaagactgccgcaaagtactgcccgcttttttccggtaaacttttttttgagctgctttacctcactgcgtgcaagcccatttttcttttctttgaactcctgtccgatgtgatcgatccagagtcctgccgcatacatgataaccgtcgccccaaacagatacagtagaagtatcccactgaaagaagcaaaaaaaatgtatcctgccgccagcagcacatacggacggtattttgttccggcaatctggtaacagatcagaatgagtggcagaaataccagcagaaacagcattgtatgatatgccatatcagccttcttcctccagtctctgtatcattgcccagatagcttctgcagaattaaagttctttgcaatcatatctcctggtgcgatctgcacatcaaatgtatccccgatctctgataccagcgagaggattgcaaacgaatccagcaaatgatcatcaatcagtgttgtacatgtactataatccacatccggattaatctcctctaaaatctccaataattcttccattcttcatttctccctctttataaaattctatctgccgctttattaagcggataaaccggcattctgctccgcagcacccgaaagccctccgtcttgcagtagcttaccaccgccggaagatcccggcttaaaaaaagtgacattccctccgtcatggaatacgcacccgtgcgctcaaataccagaagatcccccgggcgaacaccttttaaaggatactggcggatcagaatatcatttgccgtgcagagtgcaccacagatgcagtaattctgctcttcttccccctcacgtgcaaaaagcggcgtgcagaacggtgttttcatcgccataacctgtccatcgtagttcaggtgatgcatgccagcatccaccagacaatacctcgtcccctgattctcctttacttcccgcacttttgtgacaaagctgccacacattgctgcaaggaatcttcccatctcaaatgtgaccgttcccggaaaatgaagttctgtgacacagtccgccgcatcagaaagcatcgccagtgcctcttctcttccccatttctttgtacctttaaagtactccacgccaaatccaggtccatattcgagccgcggcactttaagaccaaaccgttcccagatcctgtcacatacctccgcgagctgtcccagttccttgcggatctgttcactttttctcttctgcgttcccgagaaaaaatggatccctgcgaactgcacatacttctgctgtagaatcttatcgaccgactcaagcaaaacgtcctcatccattccaaactgatttccactcgtaagacgcagcaacagctccacatttcgtccatattctctggatagacacaaaaaaagatctacctgatccattgattctgccgtaaaatgcggcaacttctccttttccagaagttccctgatatcctgttcttcttttaatacgccggaaagaatcatcttctctgccggaattttctgctcgatacagatccgcagttcccccggagaacagacttcaatatagtccgtcatttctgccatatcctctgtcagaaatggatttgccttcatcgcaaaacaaagtcccacacggtctgcaagtaatgtcttcatttccgcgacatcctctctcagacgatcgaggtcaaacacgtagcagggagtctgaaattctccggcagcttctgccagcacttcctgtctcatcttctcttctcctccctgtaatgattccagagagccgcgcggtcaatttttccattctttgtcatcggcatctcatccatatgtaaaaacttatccggcagcataaacgccggcatctgttcctttacttttcgacgcaactcttttttatcgatctctccaacgtaaaatgccaccagtttctgctcctgctccccgtagatacagcaactgcgtgtcacaccttccgtctgatccaatgtcaactgaatctcctccagctcaatgcggtgtcccatacgcttaacctgaaaatccctgcgtcctgcaaaacacagcagcccctcatcattataagtaccgatatctcctgtgcggtagattacctgcggataactctgattctctggattctgtacaaagctcttctccgtcgcctgtggattattgtaatacccacttgccagggaagtgcccgccacgcagatctcgccctgtatcccggcatctctgatcacacagttctgatcatccaacagaaataccagacgattgccaaacgcacttccgatcggaagtgccgcatcctccggttcatcgcctcttacccggtaataggtacagttacacacaatctccgtaggtccatacagattgacaaactctgccgccggcagtgcctcccgccaggctttcagatgcttatatggcatcacttccccgctgaaaagcacccggcgtacctccgacggcacacggtactcaaatccgcgcagtgtcgtcaccatgcaaagtgcggaaaccgcccaggtcagagatgtcacatgcttctcacacaggaaatccagaagcgatggcggcatggaaaacatctgctttgggatcagaacaagctttgctcccgtaaaaatggatgtatatatatccttcaccgacacatcaaaatcaaacggagcctgattgccgatcacatcacactccgagaaatcaaacgttttcgcaaactgctcgataaaatcaaccaccgcacgctgatttacaatcactccttttggcatccctgtggatcccgatgtaaaaatcccatataagagatcctgatccaaactctgtgctctcacccggtccaacgacacagaatcaatgtcagtctgctttgccgcttcgattggaaccatatttccctgatagccacatgcacgcatcttctcctcatactgcacatccagaatcatctgatccgtctgtagtgtggcgagaattttttcaatccgcacattaggatattccggattaatcagcacataaaatgcccctgcatatacaactcccagaaatgcagccagggtatctgctgatttatccatcacgacagcgacaggctttcgtatgacgtgtttcctgcataaagctgacccgatgcgttgcgcaagctccagcagttctccccacgtgtaagaaacgctcccgtcatcgaccgccgcccgctctttatacctgcttaccgtcgcttccaaacgatccaacacacaattcaattttctgtcctctactttccctgttcctgccgcttcttatctgtcaagatacttcttcacctgttcctccaggaactccggtgtatcaaaataatcaatcttcatggcatgctttacttcagaaagtgtctttgcagccgcttcctttgccacttcgcttcccgcctttaaaatatcatacacatcgccgatgcgctgctcgtattcctttctgcgcgcacggatcggagacaactcctcctgcatgacgttattcaggaacttcttcaccttgacatcgcctaggccaccgcgtttgtaatgtgccttgagctcatccaggttcgcatactctggcagatactccacgaagtgctcgtccgtacagaatgcatccagataggtaaatacggtattgccctcgagctttcccggatcttcgatccggatgtgatccgggtccgtgaacatggacataatcttcttcttcacatctgcctcgctctccgagagatagatgcagttgccgagcgacttgctcattttggcctttccgtcggtacctggaagtcttaagcaggccttgttatccgggagtaaaatctgcgggtctgtgagcgtctcgccatacaccgcattaaacttatgtacaatctccttggtctgctcaagcatcggcatctgatcctcgccgaccggaaccgtcgtcgcatggaatgccgtaatgtccgccgcctggctgatcggataattgaaaaatccgaccggaatgctcgcctcgaagttgcgcatctgaatctccgccttaaccgtcgggttgcgctgtaatctggagaccgtaaccagattctggtaatagaaggtcagctccgtcagctccgtcacgtaggactggataaaaatatgagacttcgccggatcgattccgaccgaaaggtagtcgagcgccacctccataatattgtcgcgcacctttgcgggattgtcggcgttgtccgtcaatgcctgtgcgtccgcaatcataataaaaatcttatcaaacgttcccgaattctgaagttccactctccgcttcagagaacccacataatgtcccacatgcagcttgccggtaggacggtcgcctgtcaaaataatcttttctgccattgtcatttcccctgtcaaacatattcttgctctattatacatgttttgcgggacaagttcaatttttcttttgacaatccccggaaagtttttcagaaaaatagccgtcgctgtaaagttttttcaaaaacgatgccagaagcggcactccgaacagtccaaggattccgaaaaagtgaagccctagaatcatgcacggcagcatcacaaccggcgagagccccatctgttttcccaccagcttcggttccacaatgttgcgcaccaccgtgatgatcagatacagccccatgaccccgattcccattctggcattgccgccggcaaacgcaatcaccgcccacggaagcagcacggttcccgtgccgagcaccggcagaatatctaacaccgcgatcagaaacgcaatcgcgaaagcaccctcgatctgcagaagaagcagacctgccgcaagttccgcaaacgtcatcaaaaagatgaaaacgtacgccgccacacattttcccatcgttccgaaggttccctttttgacggcagacaccgtctccttccatttttccggtatgatcttttcgaggaaatgcatgatctgtgggaaatccagttccatgaacaccgtcgatatgaccgcgagcagcaatttaaagcacatccccggaatattcaccgcaatgccggagacctgctgcagcagggtgccggacattccggtcagaagctcccctgcccggctgaccgcctccgccgactccgtacccgccgtccgcagcacctctcctcccaccgtctctccagtcaaacctgccgtccacgcgcagaaatgcttcatcatcggaaaaatcgtctccgagacaaaccgcaccacttccccgagcagttcctgtcccaaaagcatgatgcggtttccaaggaatccgatcaccagtcccgccagtccgtaaaacagcagaacgaccgtcaccgctgcaatcctgcgccttatatgcatgcgctctgtcgcaaacgccaccggaaacgaaagaatccacgccacaaaaaatgccgcaataaacggtaggagcaccggtccgatcatttttaccgccgcgaggacaagtccaccccacaccgcccagtatgcaaacttaataaggaattctttctgatgtctgatccgctcttcccgctccatggcaatcctccgcgtcatgttttctcctaataactatatccaccgggaagcgattccatgcacgacgtccgcacattcctttccagaaaaggaactgccgcaataagcatatcgcactttgctttgataagtaatattattagaagccagaggacaaaaaagttccagaataaacagacggcggcaaattctttgaagcaaaattcacgtatttcttccatgccgtggttggcatcccattccgtgtctcttccacgtttgaacactcccggaatgtgtccgacaagccgcagacaatgagcggactttctggtgtccctaatggcacctcttcacagacaatataaaaccgcgcgaaccgaactcgccggcatctgctattgaaaatagggcagatgcgactcagacagcggcttcgcgcggttatgttttgttcagaggtgaccataagggacacacacaaaagttctaaaattgtctgctggcctgcggacacagtccgtggagtgctccaaacttggaaagacatggatcatcacggatgccagctgcggcatggttagaaataccggattttgcggtcagaatttgccgccgcatgtttatctggaacttttaagtatctatttcttgtaatattacttatcgcccaaagagctctatgcttattgcggcaattcctgattcgcactttattttgttattccgcctccagcttcagcatatagatgcagttcggtttgtctaccttcaccggggaaccggtctcaagcgaataaccatccttgtaatcgatcgtgtagttgaaaatgtcgttggaattgttgttcaatgtcagataatgcttctcgtccggatagatggcaagcatcttcggataatcactgttcaccttcgtcgtaaataccggggtaagcattcccgtcttctcctcgatctcatagcacacgacagagttcacgcctgcgttgctgcagaacagatacttaccgctcttcgagatctccatacccgatgctgcacagatatcttcctccttcttcggggaagtgctgatggtctggatcttctcaaataccggctcattatcctgcacagaataatgatatacctccacaatattgagcagttcatagagaatatatgcatattcgccgtctcttgagaaacggatcatacgcggggcagactcgagcggtccacggataatgtcaatcagttccagcttgccattctcataatccacgcggtagacttttacctgatccagtccgttgtcgaccgcacacagaaacttctgatccggtgtcagtttcacacagtccacgtgcggtacgaagttgcgctgtgcaatacttcttccgattcctttgtggaaaatgccgtccgcgattccaccgatgcttccgtccgcttccagatgcatcatgctcacgcggccgtcatgatgtccgcccacgaaaagatagcggttgccatcatccacttccacatagcagcctctcattccgccgatccactgcttgttgatcgaagtaagatcaccgtccttctcgatacggaaggattctacgccctcatccgcaatggaatacagaaatctgcgatccttggaaacaaccagatccgacggattgttgatcggaaccaccttgcgctccgtcagttttcccgcctcaacgtctacatcatagatatggattcctacgctgttctcgtgtgtataagttcctacatatgcaacatacttctcctgcttcatcgtcttccaccatcctattcttttcttcgcaaaatgtcatacatggcaagcggctgtccaaggtcgatataaagcacctgcttcggatgcggcgcggactccatatcattcccctcttcatccacgattcgctgcacagtcaccgtgatattggcaccgtccggcttcatgacctcaatgctctccccgacagaaaacttattgcgctgttcaatccggtagagtccctcttcgttccgctctccgacaatgcccagatacgtgtactccttcacataggtgttgttgtcgtaaatctgcgcttcgtccgaaggtttgccaaagaaaaatccagtcgtaaactgccggtaggtgcagtttgaaatctgctcctgataccacgccatatgctccctgtaaagctccggcgactgcttgtagtcatcaatggctcttcgatatgttctcgccaccgtggcaacatacagtgctgtcttcattctaccctcaattttaaaactgtcaatacccgactccatcaattccggaatatgttcgatcatgcaaagatccttggaattgaaaatataagtaccgcgctcattctcatagaccggcaggtattctcccgggcgtttttcctccacaaccgcgtatttccagcggcacggatgtgtgcacgctccctggttggcatctcgtccggtaaagtaattggacagtaagcaccttcccgagtaggagatgcacattgctccgtgaatgaacgtctcgatctcaagatcgtccggaatattggcacggatttccttgatctcagccagcgaaagctctctcgccgacaccacgcgctttgccccctgctcataccagaaccggtaggtgccgtaattggtgttgtttgcctgcgtactgatatggcgctcgatcttgggacagacttccttagcaatcatatagacccccggatcggaaatgatcagcgcatccggctttatctcccgaagctcggcaaaatactctctcacaccgtcgagatctccgttgtgcgccaggatattggcggtaatgtatactttcacatcatgggcatgcgcaaaagcaatcccctccttgatctcttccatggaaaagttcttcgccttcgcgcggagtccgaacgcttcgcctccgatatatactgcgtctgctccgtagatcacagcaatttttaatacttccagactgctcgccggtatcagtaactccggtcttctcatattctcgttcctctctattctcacacgcatgcatcgcatcttcatgcttcatgtaatcccgcacggattccgccatcttcccatcctgcgtaatccatgccgtccttaacgccttgtgctcaaggtgatgccatctcccaccgggagcaccgcggtcaccagttcttcactgtgcgtcagcgtgtacagatattcccgcatgcgcttatgaatcgtgcggttccgccttgtaaccgcgaaccgtgattcgatcacatcgccgtcctgcagcacattgtccgacaccagcacgccgtccttcgccagaaggcgcagaatctccggcaggaaatgaatgtactgcccttttgccgcgtccataaaaataaaatcatacggatcttccagcgtctttaacacttccgcggcatcgccctccagcagcgcaatctgcgcttccttcccggctctcttaaagttctccctggcaatcggaatccgcttttcataattctcgatcgttgtaatctgacacggcacaggatcgtactccgccataaggatggcggaaaatcccaccgcagtcccaacttctaaaatacgtgccggcttcttcatggcaagcagaaacttcaaaaagctctgcatctccttccgaataatcggcacgtaatcggctgtcgcttcccgctcaatctgatcgagcatcgcagtatttcccgcatccagagaattgatataggtcacaagtctctcatctactatcacggtgtctcctctgcatcccctgcatcttctgcggtctgtgtatcgtccgtctcatctgtcagatccgccgccccggtattcccggtgtctgcggtatcctcggtgtcctcggtactttccgtatcaccggcatccgctgccatgatcacgaacatctcccgcgcagtcatcgaggtatttaacgtgtaaacacccggtttgagttttccggagtaagcagatagtttcagctgggcatagaacagattcgcatcctccaccagcccctcttcttttaacatctttccgatatcatgctccgacatatccgccgtcacggatacggtcacatccctgcccggagtttcgtccaccgggctctcggtaaacacccggtatccgaagtcatagcagtaggagccaagttcaatcagtcccaccacaacaagcagtgcaaccaggatggaaaagctgatactgacaaatttgaaaacgactttgttccatttcataatcttctacacttccataattatcggcataatcatcgggcgtctcttcgtctctttccaaacaaaatcccccagagaatccttgatctccgtcttgatcttgccccagtctgtaatgcctttatccatacagtgctgcattgtatcatcaagcagatgcttggcatcgtccatcagtccctctgcgccgcggacatagacaaatccgcgcgatacgatatccggtccggcaagtacctgtccggaaccgccctccagtgtgagcacgacgataatgataccgtcctctgccagatgctggcggtcacgcagcacgatattgccgacgtcgccgacgccgagaccgtccaccatgatggctccggtgtgtacgcgtcctgtcactgccgctgcctcatcgtttaactcaagcacatctccggaggagagcaggaaaatattctctttcggaattcccagctcctccgcaactttcgcctgcgcaatcagatggcggtactcaccgtgtaccggaatcgcatacttcggcttcaccagggaataaatcagcttgatttcctcctggcaggcatgtccggaaacatggacatcctggaagatcacgttggcacccttcatcgacagctcgttgataatgcgcgatacagctttttcatttcccggaattgggttggaactaagaacgatcgtatcgttcggcttgatcgtcactttcttgtgcacgccgcttgccatgcgggacagtgctgccatcgcctcgccctggcttcccgtcgtgatgatgacggtctgctcatccgggtaacgcttcagctcctcaatgtcgattaacgtattgtccggaatactgatatatccaagttcggaagcaattccgatgatgttgaccatgcttcgtccctcgaccaccactttgcgaccgttcttatacgccgtattgatgatctgctgcacacggtcgacattggatgcaaaagtcgcaatgatgatccggtgattcttgttgtccgcgaaaatctcatcaaatgtcttgccgaccgtcttctccgacatggtaaatcccgggcgctcagcgtttgtactgtcgcacatcagcgccagcacaccttttcttccgatctcaccgaaacgctgcagatcgatagcatctccgaataccggtgtgtaatccaccttgaagtctccggtgtgcacaataatgcctgccggggagtagatggcaagcgccgccgcatcctgaatactgtggttcgtcttgatgaattccacacggaagcagccgagattgatatgctgtccgtattttacgaccttgcgctttaccttggtgagcatattgtgctctcttaacttgtgctcaatgataccgttcgtcagcttggtagaatagatcggcacattgatctctcttaacacataagggattgctccgatgtggtcctcatgaccgtgtgtgataaaaaatcccttgactttgtcaatgttgtccttcagataggtgatatccgggatgaccagatcgattccgtacatgtcatcctccggaaaagacagaccgcagtccacaacaataatactgtcctcatattcaaaggcagtaatgttcataccaatctgctccaatcctcctaacggaatgattttgagctttccactattctcttttttttcttttttcaaaatattacctccattattatttgtctcttaaaatgcaatgtccgcgtcgtcgagcagctctgcaaacacttttccgatggcagaaagctccgtgtcgtcttccacaagcacgtagacagattcctcgtctttcgtttccacctcttttaaaatatacgcatcacagtcgccgtcttcctcttccgtcgccagaaggtagtgcgtgccgccaacttttgtctcctcaaccacgaaaaacgcgagcgattctccggtgtccggatccacaaactttactttttccatatttactccattcaatgtttctgaaacgcgagtgaatccagatatccctgcagaataaacactgccgcgatctcatccacatactgtttgcgattctctctgcgtattccactctccatcatgtgccggtctgctgcaaccgtcgtaagtctctcgtcccacaggacgacagaaagcccggtgcggcgctccagcatctgtgcaaactctttcgtcttctcgcaacgctctccctcggtattgttcatattcttgggatagccgagcacaatgcgctccacctgatattctgttacaatctgttctattcttgccagcgtctgacgcagcttgttcggagactgtcttctcacgatctccagtccctgcgccgtcaacataagttcatcactgactgccacaccgacagtcttcgagccaaaatccaaacctaatatccgcatcttctattcccagttgttattcctgatgtaagccttcagcatctcctctaccagctcatcacgttctactttcatgatcaggcttcttgcattattatgactggtgatataagtaggatctcccgacataatatatccaacaatctgattcaccggattgtatcccttctccataagcgcacgataaacaatcgcgagcacgtcgctcacgcgaagttccggtcctttttccactttaaaatattgtgtgttattgatctcctgcatatttgtcacgcccttatatctgcccggactttaaagcggtgctgccagccaccgctctcttgtcgaaaaagcattgctgtttttattctaatatagtttgtcttaaaattcaactaaaagatagacgtcttctgttaattgtgtctttaaggtgcccgtcacaaacgtgttggaaaggtctttttttgtctctaccgccactttcacatactcttttgtgtacccggtgtagtaacgctttccatcatataaaaactcttcctccagaagcgccgtcacctgtctgccgagataataccggcggaactcctccgacatcctgtgaccgagtgcaagcagtttttcgctgcgctccttttttaccgcctccggcacctgatccggcattgccgccgccttcgttccctctcttctcgaatactggaaaatatgcatctcatagaaatgaatccgctccagataacgctccgtcgtctcaaattcctcgtccgtctcccccgggaatcctacaatgacatccgttgtgattgccggatgttcaaaatacctgcgcagcagcgcacagcccgcctcatattccgccgtatcgtaccgccggttcatgcggcttaacaccgtatcgcagccgctctgcaatgacaggtgaaaatgcgggcagatcttcggcagctccgagagtctttttgcaaacgcgtccgtcacgatacgcggttccaggcttcccaggcggatccgctcgatcccctccagctcatgtaccgcctcgatcagatgcagcagcgactccccgttgtccacaccgtaggaactcagatggattccggtgagcaccacctcacggtagccgctttttgccagcgtccgtatctcctgtaagacgtccggaagctccctgcttctgacacgccctctcgcaaacggaataatacagtatgtgcagaactgattgcagccatcctgcaccttgataaacgcccgggtgtgctctgccgtgcgcgaaagcgacaattcctcgtatgcctgcttctcgtgattgatgtccgccacacacgccatcttgcggtgggatgcttcgtattcccgaagcagcggcaccagctcatgctttttattattcccgatcacgatgtcaatcgactcatccacgagagcctgtgcctccttggtctgcacatagcatccggctcccacgacaatcgcatccggattctgctttttcgcccggtgcagcatctgtctggacttgcggtccgccatattggtcacggagcatgtattgatcacatagacatccgcatactccgaaaacggcacgatctcatatcccgcctcctccaaaatctgctgcatggcttccgtctcatatgcattcactttacaacccaaattatgcaatgctgctttcattcttgtttcctcatttctgtattgctttttgttcacgctttcttatggtttcatccgctttttgtgttgacttttccacgaaaaactattactataaaactatcttgaaacagataatcctaaggaggttttttatcatgaaaacagtacagatttcccttaactcgatcgacaaggtaaagtccttcgtcaatgcaattacgcagtatgaatatgattttgatctgatctctggcagatacgtcatcgatgcaaagtccatcatgggtatcttcagtttagatttatccaagcctatcgaccttgcaatccatgcagagaacaacatggacgagattatggagactttaaagccatacttaatctaattcatacatgacaggggtacacgccgcgggatttcccgcggctgtttttttatgtaacaggagacttcgttcctattacataaacccgcaccgcgaggatgcacatctacgcctcgatgtggattacctccaccgtatcgatggcttcctgcatcagcgcatcgatcttctcggaaagctttctctcatcattgtgaatcacgtttaagctcggctttgtcaccgggtgctttgccacgaaaatcgtacagcagtcctcgtaaggaaggatggatgtctcataagcgtcgatcttctccgagatctccacgatctcctgcttgtcaaatccgatcagcggacggtaaaccggcatcgtacatacctcattggttgccgcgagcgactgcatggtctggctcgccacctgtccgatactctcccccgtaatcagtccgagacacttgttctcttttgcaaaatgctccgccagcttcatcatgtagcgccgcatgataatcgtcagttcctcatgcggacactgttcgtaaatatataactggatatccgtaaaattgaccacatgcagattgatcggtccggtatatttggaaatgatctttgccagatccacgaccttctgcttggcgcgctccgacgtataaggcggcgcatgaaaataggtcgcatcgatggtaacaccgcgctttgcaatcatgtagcctgccaccgggctgtcgattccgccggataagagcagcatggcttttccgtttgttccgaccggcatacctcccggtcccggaatgaccgtcgagtacacattgatctggttgcggatctcgatattaaacatcacctgcggcttatggacatccacgctcgtctcggggaacgcctctaagatccgctcgcccatctgggcattgatctccatcgactccaacgggtaattctttctcgcgcggcgcgcattgaccttgaacgtaaaatgcttgtccgggtatacctcgtcgatatagcggatgacttcccccgccagcgcatcaaagccctcgtcctccagcagtacgaccggacagattcccacgatgccaaacacatgctgcagtgcctccacagctccatcgtaatcgtattcgccctccatctcgacgtagattctgccctgctccttgcggatatggaacgtgccgtccaccttctttaaggcatgattcatctggctcaccagcgcatcctcaaacagataacggttcttccccttgatggcaatctctgcatatttaatcaaaaatgctttatatgtcatggctctctcctttactttctggtgaactttctgcggaacggaatgatctctttcattttttcgaccgcataatccacttcttcttccgttgtgttgacgcagaagctgatccggatcgtggactctaacttctgcttcggcagaccgatgccctgcaaggtgcggctcggtgccggcttattggacgagcatgcgcttcccgccgacacatagatgccgtattcttccagagaatggagcatcacttcactgcgcacatcctcgatcgtgacactcacaatctgcggcgcagagtcccgtcccgttttaccgtttaccgtcactcccgggatctgtgtcacctcatcgatgaacctctgcctgatctcatacatatgaccggtcttcgcgtcaaaattctcatagatctccgccgctgcctcgccgagtgcagccacgcccggaacgttctccgtaccggagcgcattcccttctgctgaccgccgccgtagatgatcggttttacttttaccttatcgcgaatatataaaaatccggttcctttcggcgcgtggatcttgtgtccactcaccgagagcagatcaatccccatctttttcgggcagatgcggaatttgccgtacgcctgaatcgcatccacatgaaacagcgtgtccggattcttcgccttgatgaccttcgccgcttcctcgaccggttcaaccgcaccaatctcgttgttcaccatcatgatggacaccagcaccgtatcttcccgcactgcatcccgcagttcctccagcgaaataataccgtcatgatccacagacaattccgtgatctcatagccgagttcttttaagtaggcaagcggcgcctgtaccgacgcatgctcaatcgctgtcgtgatgatatgctttccctggcgcttgtttgccagcgctccgccgatcagcgccatattgttcgactccgtgccgcccgacgtaaagacgatctccttctcatcgcagcggagcgtcttcgcgatctgctcttttgcttctttaatataatcctccgccgtctttcccatgttgtgcagggaggacggattgccgtaatcttccgttaagatctgcaccatcttgtttttggcgcgctcactgcaccgggtggtggcagaattatccaaatatgcttccatctgttttaaaaccatgcctttctaacaaacgccgacgcagaatcacggctgatcccgctcttcttccgcttccgacacactctcgatatgatacatcagaatagaaagggttgcaagtcccgccgtctccgtgcgcaaaattctttttccgagggacaccagatgcatcccctcctcttttgccagcgcaatctccgacggatcgaatccgccctccggtccgataaaaatgccgacgctctgccccggtgcaatccgctccatcacttcccttgtggccgccatgccgcgctcattctcatacggcagcagcaccacgtcgagttctcccgccaatgcgactgcctcccggtaattcaccggttctctcaccaccggaattctgctgcgctttgactgttttgccgcactctttgcaatctcctgccagcgcgccgtctttgccgccgctttttttgcatccagttttacgacgcagttcttcatcgccaccgggatcatctccgcagcgccaagctccactgccttctggatgatgagctccatcttgtcgctctttggaagtccctgaaacaggcagatccggcagggcagttccgtatctaaagccgtctcctccgtgatgcacacctccaccacgttctctgcgatccggtcaatcgtgccgaagaaattcctgccggatgtgctgctgatgcgcactttttccccgcatttcatgcgcaggacattgcggatgtgatttacatcgcttccctcaattatcaccagatcatttgcaatctgctcgtcttccacaaaaaactgatacataaactcctcatttccgggctgcctgccattccttcggatcatcttccttttttcggatcgtctttccttattccagatcgtcttttctttttccggatcgtcttccttattccggctttctcgccgtaatgttcacccactcgccctgatgattgatctccaccaccgtaagtccggccgcttcgatcgcttcttttaccgcgttctccttgaaatcgatgatgcccgaggtgataaaataaccgccgcgtttcaagcgtgccggaatcaccggtgccatcggaataatgacgtctgccagaatgttggcaaccacaatgtcgtattcctccgtgccgactttctcctgcagtgctgcatcatcgatcagattgccgacataaaatgtgccaagcgaaggatcgagatggttcacttccatattctcatgtgtggaggtcatgcagtccggatcgagatccgttccgactaccgcggacgcgccaagcttcaacgccacaatcgataaaatgccgcttccgcagccgacgtcgagtaccttcggcgtgcggttttccggtgtgtacgcatcgttcccgcggatatactttaacagctggcggatgcacagctgcgtcgtttcatgcttgccggttccaaacgacacacccggatcaatctcgattaaaaatttgtcggcatcctccggctttaattcctcccaggtcggtttgatcaggatgtcatcaatatagaaggaactgaagaatttcttccagttgttgatccagtccagatcctccgtctggtcggaggtgatcacgccgcttccgacatccacgacttttcttaagtcctccaacgcctcttttacctgctttaacagttcggtgcggtcctcgccgtcatcctcaagataaaagctgacgtggctcacaccgtcatccggcggaagctccggcagaaaatcgatgaacatatccgcctgatcttccttggacagcggaatgttatcctcaatctccactccctcaatgccaaggtcggctaacatcgcactcatgtagtcctccgccgccgtcgttgtctctatcgtgtatttattccatttcatatgcgttcttccttcccttacgattccgttcctaaaaatcgttatttatcttatcatacaatcgcacatcttgcaaacgatgttccgccccgctctccgcctgcgggaggtattcctgatgcagtatacaaaacacattctttgcctgttgcacaaaaaacgggccgcggcacctcttttgcgccggacagcccgtccttatttcttcttacaatacctttgataaaaactcctgcagtctctgactctttggattgccaaaaatctcctgcggggttccctcctcctggatcacgccgtcgttgataaacatcacacggttcgcaacttctctggcaaatcccatctcatgtgtcacgaccaccatcgtcatgccatcctccgccagttcctgcatcacggcgagcacctcgccgaccatctccggatcaagcgccgaggtcggctcgtcaaacaggatgatgtccgggtccatcgccagcgaccgcacgatggcaatgcgctgcttctgtccgccggaaagctgcgcgggatacgcgcccgccttatccgccagaccgatgcgctttaacagctccatcgcgcgcgtattcgcttcctcttttgtcatcttgccgagttttaccggggcaagcatgatattttccagaatcgtcatgttcggaaacagattgaactgctgaaacaccatgccgatcttctcccggacatgattgatgtccaccgacggatccgtcagatcggttccctcaaacagcacatgtcccgccgtcggaatctccagcagatttaaggagcgcaaaaacgtggatttaccacagccggacggtccgatcagcgccagcacatcgccctttttgatcgtcgtcgagattccttttaacacttcatgaccgtcaaaagacttgtgaagctcttttacttccagaattaccgtattatcgctcattgcttctcaatctcctttccaacagtccgactgccttgctcagtcccatgacaatcaggaaataaatggccgcgaccgcaattaacggcatgaacgcctcgtacgtcacgcttcggatgatgtctccgcccttggtcagatccatcagcccgatgtaaccgctgatcgaagtctccttcaacagactgataaactcattgcagagtgccggcagaatatttttgactgcctgcggcaggatgatgcttaacatcgtctgcttataatttaatccaaggcttcttcccgcctcaaactgtccgatgtccaccgccataataccggaccggacgatttccgccacgtaggccgccgagttcagtccgaacgcaatgactgccacgaacagttttcccgtattgacgctctggaaaatgacataataaataatcagaagctgaatcatgaccggcgtaccgcgcacaacggcaaggtatgccttgcagagtgcatttaagatcgtaagcccgccgtttctgtcgtggttggttcttacaatcgcgatcaaaaatccaaacacaataccgatcattaccgcaaacacggtgatgatgagtgtatttaaaagtccctttaacaaataggtatatcggctgtccttgataaagttatcataaaacttctctgctatccctgtcttctctgctgtgacagatgtatctctcacgatgatgacctgcttggattttgcataggtatccgtgaaattcacattctttttgcgttcctccgtcaccgtaaaacccgatgcaccgatgtcgacttttccggtggacaccgcaggaatcacggaatcaaacgccatgtcctcgatctttaactccatgccgagtttgtcgcagaccgcctgcataatatccatgtcgattccggtgatctttccctcttcatagtattcatacggcggaaactccgcattcgtaccaacggtaagcgtgccgttcgtgcgttccacatccagaatttcatacggatactttccaatctcctcgtccgttccggtataattcttcgcaatgctatcgagaacaccctcgtccttcagttcgcgcagcgtctcattgacctgatccacaagtgcctcgttaccctttgcgattacgaacgcatagtcctcctcaacaaagttctcctcgagaatcttaagcccttcgttctgctccacaaatgccagcgccggcaattcgtcaataatcacgcagtctaactttccctgctttaatgcctgcacggcatccgcgcccttattgtaacgctctactaccgtgcccgagccgtccgtctcatagtcgctgaccatgatatctccggtcgtgccgagctgtacaccgatatgctttcccggaagatccgcaaccgacgtaacagaaccgtcgccggatgcctgtcccgcctccgtgtcgctgcctatcgccgtcgccgcggcaacctgtgtgccgtaacctaacagcgtcgaaaaaaagaccgctccggcaagcagtatgccggataatttgattgctgtgtttttcatcgtactatctacctcatgcttccttatctctcacatagatactgcataaatatacatccggcagtcagtataacacagaacgccccgcttgggaagagattcattcaatctcgcagatccggtagagataacttcttccctgctttccaatccgctccacaatcaatagatccgtcaggagcaggagcaccgtctgtgccagccgcaccggaatcttcgcgcatgccgcaaaatcctttgcagtaaactcctccggaatctcataggggatgaactgcatgtagtcctccctccggtccacacgcacttcctccacgaaggtaagcggtatccggtcgaagcggtcgcttcccttctttttgtcccggctccagccgtttaacagacggtattcctccatgtcaatgagatccagccgtagtctcagattcggatctttcagaaacggccggatcttatacaattcgatgaatgcctggtatgcatttcccttcttgggcgatttgcgcccgggagagatctcccccgtctcctcatccatccagtgaagccacttcacatgcggaatcggatagacgatggtcaccgggtacaacggcagaaatgcggcaagtttccgccgcatattctggaacgaccgcgtctgaatctcgatcactgcctccccgtcaaaaatatccgcaacaaaattctcaatcgggatctcatgcatatcctcatccggtgcataataattcttgagcactgcatgtaccgtcttctccgagagtgtgccgattccaagcctctgccgctcgattccaatgactctgcccctggcacgctcaaaacgttctgtatcaatgcacatatctcatcctcgctgctgtgctttttccggaatgatctgccgcttatttcgggtgcttcatatcctttaagatatcaaagcagtcaaacgtgcggaaatagtcctccggcgtctcggcacgacggatcagctgtgtcgatccgtcttccttcagcagcacctccgctgactttaattttccgttatagttgtatcccatggaaaaaccatgcgcaccggtatcatgaatcaccagaagatctcccatgtcgatcttcggcagcatccggtcaatcgcaaacttatcgcaattctcgcaaagtgagcctgtcacatcatacttgtggtcgcacggcgcatcctccttgcccatcaccgtaatatggtgatatgccccgtaaattgccgggcgcatcaggttcacggcacacgcgtccacaccgatgtactccttgtgggtatgcttctcatggatggccgttgtcaccaggcagccgtacggtcccagcataaaacgtcccatctccgtgtagattgcgacatcgccaagtcccgccggaactaagatctcctcatatgccacccggacgccctctccgatgacacggatgtcgttcggcgtctgatccggtgtgtacggaataccgacaccgccggagagattgataaaacggatatcgcatcccgtcttatcgcgcagttccacaaccagttcaaacagttctctcgcaagcttcgggtaatattcgtttgtcacggtattgctggcaagaaacgcatgtacgccaaaatgcttggctcccttctcctttaagatcttgaatccctcaatgatctgctcgtgggtaaaaccgtactttgcatcgcccggattatccatgatgccgttgctcatcttaaagacgcctcccggattgtaccggcagctgatcgtctccggaatcctgccgatcgttttttccagaaaatcaatgtgtgtaaaatcgtcgagattaatgatcgcaccaagctcattggcaaatgcaaattcctccgccggcgtatcattggaggaaaacatgatgtgttttccatcgaagccctgggaatccgcaagcatcagctctgtcagcgacgcacagtcacatccgcagtcatattcttttaaaatgtcaagaatgaacgggttcggcgttgcctttaccgcaaaatactcccggaatcccgggttccatgcaaatgcttccttcactgccttcgcattttcgcggattcctttttcatcgtagagatgaaaaggcgttgggtatttttttacgatttcctctaactgttctttggttacaaatggtttcttcttcatacggttcttcctttcttcctagaatacgacttgtatcaaaaacatataaagtgccgttccggcaccaatgctgagcagattgttgcgcttccatacatgaagcatgatgaccgccgccacggcaataaattccggcaggccgaaaggcgccgcaagcaccgacacgtttttcaggcagtagatcaccagcattccgatgaccgccgggggcagcactctccccagataccggatgatcggcggaatctcttttcctttcgggaaaaacagaaacggaatcagcctggtaaaaaatatcgttcccgccacggtaaatatgatcgcaagcgatcttccaacacttactggcactccggctcgcctccttcctttccgtcctccggaatcattttatcgaatatttttttgcaggaaagcaggatgaccatgacgcatatcatggtcggaaggataaaattgtccgctccgaacaccagcctgcacaccagtccacataccagcccgatcaccacgctcggacggttctgcttctccatccactgttccaccatgattaccacaaacaatgccgtcattgcaaagtcaatgccctccgtggagaacgggagcacatttccaagcagggcgccgatgccggagccgatgatccagtaactctggtcgagcacggcaatcgcaaacaagaactgctcctccttcacatctttcggcacttttgtgacgaagaaaagcgagtaggtctcatccgtcagggaaaagatcatgtaaagccgctttttccccatcttagaaaatcgttccagcagtgacagtccataaaaaatatggcggatattcaccataaattccatgaaaatcacattgaggaggctgacgcccggcgcgaaaaagttgactgcaagatactgtccgctgcccgcatagatcaccagactcatgagcatcgcccacaagaagttgtaacctttttcctgtatcatcactccgaacgccatcccgataaacagatagccggtgagcaccggtaccgtgtagggaaacgctgcccgaaatgcacgtaaatatgttcctttccgctcgacttgtttggttttcatttttttctttcctaatcccgcaaattatgctatactttttctagttatacattcagtgaagttgttttcaagggagttaccaatgagtattacgatcttaaattatcacgatcaggcatttgtggatcagatcaacgccgaagctgctgcccgcgctgaagcggagagagctgccgccgaagctgcaaaagcgcaggctgcaagttctgacttttcttccgttttaacgaatgccaccgacgcctactccggcagcacgacctgctccggagacctttccgccatctttgatgaagcggcgaacacctacggcgtctcctccactcttttaaaatcaatcgcaagagcagagtccaattttaatacaagcgctgtcagcagcgccggtgctgtcggtattatgcagctgatgcctgccaccgcagcatctctcggtgtcacagattcctacgatgcctaccagaatatcatgggcggtgcgaatctgatctcccagctgcttgccaagtacaacggcgatacctctcttgcgcttgcggcatacaacgccggcagtgcaaatgtcgataaatacggcggtattccaccgtttagcgagacacagaattatgtccagaaggttctctcctatatgggaagcgatacgaacaccgttgcatccgcatccactgcagagacttccgaagatgttgcaacgacggtaagcaattttatcgcggcaaacaacatcagccaggatacggtagagaagctgcttacgcttcttgaagtgttaaacgcttaacaattacatttcatacaacagtaacacatgagaatcctgcctgcaggattcttttttgtgtaacaggaaacttcgttcctattacataatatcatccttctgcctgcgtccctgtaatcgtctcgatctgctcttccagatagccgttgaactccgtcataaaacggctcaccgtcctcacatcctcgacggaatagcgcgccagaaattccatatcgcgcttctcccatcgctgatgccgcttcgcatgctcatcaaacaaaagcctgccctgatccgtgagcttgaaatatacttcctttttgttcgtctccagcgtatatttttcgatcagccctttggcaagaagcttcttggtcatcttgctgatcgcgccgcgcgtcatccccatgtgctccgccaccttcgtgacgttcggcagttccagtcttccgatatagtcgatacagtgtgtctccgaatagccgtattcatccagacactggttttccgtcagtttggaaagcatatcctgccgctccagcatgagcgcgatttcttttaacagctcttcccgatctttcatgcagactcttcctttttctaacatggtattttgttcccagttcctactgtatctcattattgtttccatgtcaacaatatatttcttttacctgccgctgatgatgccgtagcactccgggcgcctgtcgcggaacagcccccactccagccgtctggcatccagctcgtccaggtcatattcctgcaccagtatctcttcctcgtcgcgccctgcctccgccagaatttctccggtctcatcggtcaggaaagacgatccgtaaaaaacaagcgccgaacgctgtccgccgttttcctcacagggttctaccgtctcctccccgatccggtttgccgcaacaacgggcatcagattggctgccgcatgtccctgcatacagcgtctccagtgcggcatactgtcgcactctaagatcggttccgatccgatcgccgtcggataaaaaagcagctccgcccctgcaagcgccatacagcgcgcgctctccggaaaccactgatcccagcagattcccacgccgattctgccgtagcgcgtagaaaatacctgaaatccggtatcccccggcgtaaaatagaacttttcctgatagtaatgatcatccgggatatgcgtcttgcgataaacgccgagcactgttccgtccgcgtcgatacaggcgatggaattgtacaggttgttcacatcccgctcataaaagctgatcgggagcaccacaccaagctccgcggcaagccgcatgcccatgcgcaccgcatcgttctccatcacaggctttgcataatgatagaagtcataccggcgctgctggcaaaaatattcccgctcaaaaagttccggcagaaggatcacgtttgctccctctgccgccgcctttcgcaccatggcttccgccttttttaaattctcctccacagacgccgcacagcgcatctgaattgccgccactttcactctgttcatgctcttttcctctttttgtctctgtccactttaccgctgctacatttttgctgctgcgttttgctgctgcatttttgccgccgggatctgctgtgtaatacagtggatattcccgccgccgactaaaattgcacgcgcctgcaccgaaataatcttccgccccggattccactgcgcaagcagtgcggcagcgcgcctgtcactctcctcattctccccgccgaacgccggaagaataactgcctcattggaaaaataaaagttcacgtaggatgccgcaagacgctctcccgcctcccgctcatcctccccttcggcaaacgaataacctgccagttcctcctctgtaatgcagaccggatgatcgggaatcggaagcttgtgaatgacaagctttcttccgcgcgcatccgtctcgccctccaggtacgcaagcgtctgctgtgatagcggatactggggatctgtttcatcgtccgtccaggcaagcaccacctcgcccgggcgcaggaacgcgcagacgttatccacatgttcgttcgtctcatcctgatagattccacgcggcagccacagcactttttctatgccaagataagttctaagcttctcctcgatctccccgcgcgtaagccccggattgcgccccgcgctcaaaaggcacgcctccgtcaccagaagcgtcccctcaccgtcgctgtgaatcgatccgccctccagtacaaacggcgcggcatcgtaacacgcatagccatactttgcggcaaacgcctttgcaaacgcatcgtccaacgcccaggatgcatacagtccgtccaccgatcctccccaggcgttaaatgaccaattcactgcccgcatcctgccggcgccgtctttcacaaaggtcggcgccacatctcttgcccaggcatcgtctgtctccagttcaaagaccgtcacccgctttttccacggcgcgtcctcaccgatcagcatctctcgcgcggagtcaatggcatcccgcccggctgccacatatacgttttcactctgcgcaatcgctgcaatcacatcccggaatgcaatccgcgcatcgcgtgcgccgtaaatccaggaacccgggcgcgacggccagatcagaatacagccgtcatgcggttcgtactcccccggcataaaaaatccgtccgcctgcggcgttgtcattctctcttttggatcttctgcacacttttgcatctttttctccatttcctctaccctcatccaagtcatcttcccttgtcccggatgtctttcaaaaccggttatgacaaccgccctttgaaatcttcatagccgaactgctttaacatctcaacctccccgtcttcccggagcattgcgatcgacggaagcggaattccattaaaggtattattcttcaccatcgagtagattgccatgtcctcaaacaccagacggtcgccgatctgaatctcatgtgtgaaactgtagtccccgatgacgtcccccgccagacaggtgagcgaggacagccgataggtgtatttctgctcccccgccgcaaatccgtcccgaagcggtggacgatacggcatctcaagaacgtccggcatatgacacgccgcagacgcatccagaatcagaatatccatcccgttgtgtacaatatcgcacacttccgttaccagatatcccgcatttaaggcaaccgcctcgccgggctccagatacacggcaagtccgtaggtctccctgatatagccgataagcttctttaaacgctctatctggtaacccggtctggtaatatgatgtcctccgcccagattcagccaccggacctgttttaaataagaagcaaactgctcctcaaacgcataaaacgtgcattccagatcatccgcgtcctgctcgcagagcgtgtgaaaatggagtccctccacatcctccggcagttcatagcttccatcctcctgccgtctcatgccaagtccggcaagtcctttctcaaacgcctctcttgtcatgccgagtctggaaccgggcgcgcagggatcatagatcgcatgtccctcctgcgtggaatactccggattgatccgaagtccgatgctgacacggtgctccgtaccactggcggcattctgcgccgccaccttcttcctatgtctgacatactgcgcaaaggaattaaaaatcacatggtcgcagagcgtgaccagttcctccatatcgctgtccttgtacgccggagcaaacacatggttctcacgccccatctcctctgcgccgagacgcgcctcgtagagtccgctcgctgtggtaccgctgatgtattgtccgatcaacggatagagcgcatatgtggaaaacgctttctgcgccagcaggacatggcatcccgtatcctgctccagattatgcaatattattaagttctcttttaattttttctgattcaccacatagcatggtgtcggaagttcattccacttcattgctctcgtctctccctgtccggctctttttacgaacggctacgccaccgtcttggggttctcatcgacaacccacggcagtccgtactgattgagcatatccataaacggatccggatcaaactcctcgatattgaagacgccgtccttatcccacaccttatctacaacaagtgctgcaccgatcattgccggaactcctgtcgtgtaggagatcgcctgtgagccaacctccctgtagcactcctggtgatcgcagacgttgtagatatagatcgtcttttccttgccatccttcttgccggtaaaaatacaaccgatgttcgtcttgccaacggttctaggacccagtgacgccggatccggaagcaatgcctttaagaactggatcggcacgatctctcttccctcatactggatcggggaagtggagagcattccgacatcctccagacactgcatatgagtcagatagctctgaccgaaggtcatgaagaaacggatgcgcttgactcccggcacattctttgccagagactcgatctcctcatgatgaagcagatacatgtctttctcgccaacctgtgggaaattatattctcttttaatttccatcggttttgtctctacccagtgtccgtcctcccagtaggagccgtttgcggatacctcgcggaggttgatctccgggttgaaattggtggcgaacggataaccgtggtctccaccgttgcagtctaagatatcgatgtactcgatctcatcgaaataatgcttcagcgcataggcggtaaacacgctcgtcacgcccgggtcaaagccgctgccaagaagcgccgtgatgccggcatctgtaaagcgtttctgatatgcccactgccaggaataatcgaagtacgcggtaaagcccgcctccttgcagcgcttctcataaattgcacgccacgccgggtcgtcggtatcttccggttcgtagttcgcggtatcgatgtagtccaccttgcatgccaggcaggcatccataatcgtcagatcctggtaaggcagcgccacatttaacacggcatccggcttgtagtcacggatcagtgcgatcagttcgtccacattatccgcatccaccttcgctgtcgtgatcactgtatccgtcgttccctgcagcttttcttttaacgcgtcacatttttcttttgtgcggcttgcaatgcagatctccgaaaaagtcttgctgttctggcagcatttgtgaattgccacccctgctactccgccacatccgataatcaataatcttcccatctacttatcctctcattctgccgtcctgcggctgtattttctattatatcattctgccaacggatgacagaacgctccgctgactgtcccgtcagagtccgttctgtcccgcatctgccatctaccttctgccttcctcttcctcaagcatatcctcgacatattttggcagcataaacgctcccttatgaagattggtcgtataataccaggtcttgatcccgcgcgctttccagcgctccacattcagatccgttagcgggtgatatttttttgacgcaaatccgaacagccagtacccggaggaacaggtcggaatgtgcgcctgatacacacggctgatcgggaaactgtgactcgccttgcggtgcatcacgcggcaggactcctcatcctcgtcataaaaaggactgccgtgctggtagaccataatgccgtcttcttttaatgcgcggtaacagttcccataaaattccttggtgaacaatcccgccgtatgcccgagcggatcgatcgcatcattgatgatcagatcgtaggcatcatgctttgtgcgcagaaagcgcagtccatcctcgtaatagatattgacgcgcggatcttccagtccgcaggcgttgtccgggaaaaacttcctgcacacatccacgaatgtccggtcggattccacgacgtcgatctgctcgatctcctcataataggaaagttctctcgccacaccgccgtctccgccaccgatgaccagcacttttttcacatgcggatgcaccgccatcggcacatgcacaatcatctcatcgtagatgaactcatccttttctgagaagacgatactgccatcggagcttaaaaatctgccgaattccctggattcaaacacgtcgatcctctgaaaatccgtctgctccccgaacagctgcttctccactttgaccgacaccttcacatgatcggtctgattatccgaaaaccataactccacgctctcttccaccttccccagaccgtatcgcacggtctgctgcttccttacgcctgttcttcctgactgtatgctcttccttaagagctattcttccggcggtcttatttccacacctgccggtcatccactaagacatttaagtgctccaccgccggatcttccgttccctgcatggagcagcccttctccttggcatagatgatatattcgatgatctccggcgtaatcatctcacccggcgcgagaatcggaattcccggcggatagcacatcacaaactctccgcagatctttcctgccgtctcccggatcggcatgcattttttctctgcgtaaaaagccgcctgcggtgaaacaagaacagtcggatttatatattctgtatttaacatctgtgcagggtccttggaatacaagcgtttgacgtctgccaacgctcccaccagccgctcgatatcctggatgcggtcgccgattgaaatgtaggctaagatgttggcaatgtcccccagctcaatctggatatcgtactcatcccgcaacagatcatagacctcgattcctgccagaccgattccccgcgtatagactgagagcttcgtcacatcaaagtcatagacgcttccgccgttcaccatatccttgccgtaagcataatatccgccgatgtcgttgatctccgccctggcatattccgccatctccgccactttgcggaacgattcccttccgcgcagcgccagatttctccgcgagatgtcgagacttgacatcagaagataagacgcgcttgtcgtctgtgtgaggttgataatctggctgacatactcccagttgacatttttgccggttaaaagcagggaactctgtgttaagcttcctccggatttgtgcatggagacggacgccatatctgcaccggcatccatcgcgcagaccggaaggtcctccccgaaatacagatgggtgccgtgcgcttcatccacaagcacaagcatctcgtgttcatgtgccagcttcacgatggagcgcagatcggaacagattccgtaataagtcggattgttcacaagaaccgccaccgcgcccggattctccagaatcgcccgctccacctccgagatctccataccgagtgaaatgccaagctttttgtccacctccggattcacatagaccggaatagcgccgcagagtaccagtgcattgatcacactcttatgtacattgcgcggcaggatgatcttatccccggcacgacagaccgacaacaccatgctctgcacggaggacgttgttcctcccaccataaaaaacgcgtgatctgcccggaaagcctccgccgccagttcctccgcctctttgatgaccgacaccggatggcacaggttgtcaagcggcttcatggaattcacatccagactcacacatttctcccccagaagttccacgagctccgggttgccacgccctctcttgtgccccggcacatcgaaaggaacgactcttctcttttttaattgttccagcgcttcgtagaccggagcgcgcttctgggatcctgcttccatgattctcctcacattctgttttgatgctccctgatgcggtatgcatgccgtccggcagagcttttggctctacaggaagcatgactttcatgctttcgcataacatggcatcttctgtagcacaagaaagaatcctgcccggagcgtttttatgtaatagggacgaagtttcctattacacaaaaaaaagacagatgcctatatgctgcgcacacatcacctgccttgtcacattctcatagtcatactttatgtaatctgtcctacatgctgcaaaaactattatcagagtctacgttggcatcttcgccagcaaatatttgctattactactcttattgaccgtttcacaagtgatatctctatcgcatacgattcagggtcctgcagtccttcgcctgcagtcgtcatcaacttataaaatttgagcttctaactcaatcaataacgtggatctctccaccatcggcagctgccccgcctgtccgtatgggcttaaccaatctcttggtgggcaaatatttgcatgaaaaagctttcgcattcatgtgatttgaagtataacacacacacttctaaaaagcaatgtatttctccggattcttatctactccctccactcccggaaaagtgcaatctctctgcggtatccctcatcgtcattcggagtctccagaataaacggcttgtccgaaagcagcggatgcgtcgccacacgccgcatcgcatccagcccgatctttccctcgccgatgcaggcatggcggtctttgtgcgaaccgcggtcgttcatgctgtcgttaaaatgtaccgcgcacaggcggttcagaccgatcacatggtcaaattcctccaggacaccatccagatctcccgcaatatcatatccagcatcccagacatgacaggtatccagacagatgccaagcttatcggacagctctacacggtcaataatcgcgcgcagttcctcaaagcttctgcccacctcactgccttttcccgccatcgtctcgagcagaaccgtcgtcgtctgctccggcgtgagcacctcgttaagtgcctccgcaatccattcgattccggcatccgccccctgtccgacatgggaacccgggtgaaaattgtagtaattccccggcgtgtactccatccggcgcagatcgtccgcgatcatctccttagaaaacttgcggatatcctccttcgccgcgcacagattcatcgtgtaaggtgcatgcgccaccagttttccaaattgctgctcccgcatcagttccagcagcttttccacatccgccggatcaatcgcttttgccgcaccgcctctcggatttcttgtaaaaaatgcaaatgtatttgctcccagcttcactgccatccgccccatcgccgcatagccctttgacgccgagagatgatttccgatatacatattcttttcctgcttccttctatctttctaagtcagcaaccaccagttcaactggtggtttgctataagccctccaaagggctatgttactgctcgccccaaagggcggtgtcacaagcatttttactggtccgctataaagcggtacttcttgaatcttcttttcttgattcttctgcttgttcttttatatacttctgtactgcctcgtctgtgatattaccgattgtttccacataatatcctcttgcccaaaatgctttatcccacttactctgcaactctgggtgacgatcgtatagcattagggtgcttttaccctttaaatatcccataaaatctgagacacttaatttcggtggtattgcgacacttaaatgcacgtgatctgcacaaactgctcctgcaattatttctacatttttatatttgcatagtgtatttaagatttcacgtacatcctcccttaccttcccatacaatacctttttccgatattttggaatgaaaacgatgtgatattggcatttccatctagtgtgtgatatgcttttattgtccacttggaccacctcctgtgttgagtttggcttgcgacaccattctcaatataccacaggaggtttttcttttttatcctcaccgtttccaactattccattctccccagcatagctgggggattaggcttttcatttaaatcttctccaccaggatgccgtcccggtatgcctgcagcagcgcctccagatcacggatcgaagcgcgcagctcccttccaatgtccgtatccgccaccagcttgcgtcgcacgacatgctgcaccagaatcgtatgcgacgcgatatcgcttccgtcctgcaccgccttttcgaccgactcaaacggttcatgcgccgcaagcaccagaccgtaggaattatagatcagcgtatatcccgcaatccccgtcttcggctggtaggccttggagaatccgccgtcaataatgagcagcttcccgccgcattttaccggggactctccccgcttcgcctccaccggaatatggccgttgatgatatgtgcctccgcgccctcaagcccgaattccgagaggatgcggttgaccacctcttcctcctccagcaggcggtagtacgggttcttcggctcctggtgcgtcgctgtgtccgcgataaaatagcgctcaaacgtcgtcatttttgcttttccgaacaccggggaattctggttttcccagataaaccacaagatatccagcccctttttcttctccccgggatcaatcgcgtagtacccttttctcgcgtaattctccagcacatcgtagagcgccttgccggaatattcttttccgtacacatttactctggtaaaggttccgtcctcgttcatcggcacacagccgtggtagagcaggttcccgttgtagaccttgtacaggctgccctgtgtgaacagaaaacggacgtgacgctgtaatttttcacagttcaagaacgcctgcgtgatccgctccatgacgtcctcctcctccgatgacagttcatacggatgcttccagtcgatcgtcgggaagttcagatccttcatcgggtattccttcccctccacacacaccgttcctttttcgatattgatcttgtccagcaaaagccgctcatccatcccgaactccgggtgacgcatgatcatctgtccctccagcttgaactggatcaccgtaatcgccttgtgcattttctcatccagcatggcgtcacgcacatcgtactcatcctcccggtaatccagcttaaagcaggtgcagggatccttgtcgtatctgctcatggcaagtctggcgagcggcaccagattgatgccgtatccgtcctctaaaaggttcagattgccgtacttggcagagatacggatcgcgttgcagatgcagggtctgcttcccgccgccgctcccatccagtatatatcgtggttcccccactgaatatccacggaatgatgctgcatcaaggtatccataatcagattcgggtacggtcccctgtcgaaaatatctcccaccacatgcagatgatccaccacaagcctgcggatcagattgcagaacgcaatcacaagctccggcgccctgcctgtgcggatcacagaccggatgatctcattataataagcttcctgatcggagacatccggtctgccggtcagcagttcctcgatcacatacgcaaaatctttcggcagcgcttttcgcaccttggatctggtatattttgacgaagcgctcttgcagatgcggatcagccggtatagggagaccttataccagtcctccatattttcttctgtctttaacacctgctctagcttctgctccggataatagatcagggtcgcaatcactttcttctctcccgcactgatcgcattcccgaattcttcctcgatcttgcgcttaatcgctccggaaccgttccggatcacgtgctggaactgatcgtactcgccgtgaatatctgtaatgaaatgttctgttccctttggcaggcttaaaatcgcctgcaggttaatgatctccgtcgctgccgcagccacggtcggatactgatttgccagactttttaaataccgcagatctgtttccatatatttttccatatgttccccctcagaatatcaaaatcgaagatacctctcaaatagtaacatatccgcgcactgctgaccagattttgttcgttttctgccctgtataaaaatgggaacagaaaacgtttccacgctcctgttcccattcgatccatctgtatctgctttcaatctgccttatccgtctgcctgtccaatcagtctgcctgttccatcgttgcccggatcgcatcctgcatatcataaaatcctgcctctttcccggcgaggaactttgccgcctccacagccccttttccaaagacgctgcgggaatatgcggtatgcttgaactcaatgacctcgtcgagtcccgcgaagatgacctcatgctccccgacgatgctgcctccgcgcactgccgagattccgatctcgtgcggatctctctttttgcgctcgctgcttctgtcatatttgtattcatagacatgtcccagcgcatcattcatggagtccgccagcgccagcgctgtgccgctcggtgcatccagcttctggttgtgatgcttctccacgatctccatgtcaaatcctgccggcgcaagaatcgttgccgcctgcgctaaaagctgcatcagcagattgattcccagcgacatattcgcggactttaatactgctacctgccccgatgccgcctttacctgctccatctgttcctccgacaatcccgtcgtgcacagaaccactggaatctttttatccacactatagaccagaagatcgtccacggccttcgcattggaaaaatcgatgatgacatccgccttcacatcgcagacggaaatattcgggaataccggatagtcatttttgatcccgtcatagagatccactcccgccacgatctcaatctgcggatcctccttgcagattgcggagatgacctgtcccattttaccattgcatccattcatgattgccttaatcatcgtacgttatcctctcttctctgtactgcccgctccgcgtgccgcatgcagccagcggtgcagacacatactccggcggatggccttacggctcccttccgccggagtcatctgttcttttatgctaactttattccgtaatttttcatcgcttctgcaagcttcgcggcattctccggtgtcatctccgtgagcggggaacgaagcggtcccacttccagtcccatcagattcaatgctttcttcaccggaatcgggtttacctcggaaaacagcgcatccacaagcggctgtgcctttaactgcagttctctcgcgcgcaaaagatcccccgcggagaaagccgcgcacatatcgtgcacatccgccggcgccacattcgaccacacggaaatcacaccgatcgcaccgattgccatcagaggcaccacgatgccgtcctcgccggaatataaatcaatcttgccgtccgttaagtacatcagcctggatgcctgagccagactgccggtcgcctccttgatacccacaatgttctccacgttcttaaagagtgtggctgcggtctccggcagaatattgcagccggtacgtccaggaacgttgtacatgataatcggaagctttaccgcctcggcaatctctgtatagtaacggatcaatccgccctgtgtcgctttgttgtagtacggggtcacagccaaaagtccgtctgctcctgccttttccgcctcttcggaaaggtgaatcgcctctctggtgcagttggaaccggtgccggcaatgaccggaacacgatgctttgcaaaacgcactgctgcccggatcacatcggaatgctcctccgtagtgagcgtcgaactctctccggtcgttcccacaatcacaatcgcatccgttccctgctcaatctgccattcgaccagttcctccagcttgtcgtaatttacctcttcattttccttcatgggtgtaacaatcgctacaccagcgcccttgaatatcgccatgtcaatcctccgtttctcctatgttaatatatgcccatggtacaattttgcccctgtcagatcagagtcagaataaaaaagtaaaaaaaagccggctcgatgagccggtctgattcttctgccgcatatctgcatgccattatacagaaccgatagcgccccatctgcaaagatgacagtcataaagttcttagctttatgcccaagaaccagggcagcaggtgccttgctctttcggcatgctttccttttgcttcccttcccctgtgcctgtcacatccggaaaactactcttaaagcacgcaacctctatcaaaatatgtatcatatagttaaaattaacatagcactatcaacaacggttgtcaataacggaactttcgattattcctctaaaaaatccaccttgctgacggacacctcgtaagccacccgtttttccgtctcaagctccgagatctttttgacgtattcccggctctggattctgccccatacctgcacatgtcctcccacctcaaagccggaggcaaaccgggcgtttctaccccagcagatgcatggaatatagtctgattttccgtaggaacggttgacggcgatcagaagatccgcaatctcccgtcccagcggcgtcttccggtaaatcggttccttgcagatatatccgtccagaaaaatctggttgctcttcatatcctcctgcagctcctccaaaaactccagttcccgcacgaacaccgataagacaaggcggttctttttctcctcatgccggttaaacgaacggaactgcccgttcacataaatgatctgtcctatgtaatctgcatttacgtcaatcaaccgttcggatatcattagcggaatgtaatccagataattgctcaggcggttcactgccacatccaccatataaaatccctctccgtacacttcgtgactgaaccggaaatcggatacaatctctcccataattgacacctggttgttttcaaaaattttatctgccatgaatctttctcccttcttacgaccatactcttttttgcgttgttcttctttttcgttccgttctgctggtatgatctgcctgacacattatttttatcacgtccggtgccagaattttcatgcaacatgtcgataacaaagggaatgaaatggcggattttgtcgcaagtaccacttgcgcatctccgaaaatatgataaaatagattggttacttttttagactaggtttcacacaggaaagagagattttgtatatgaaaatgaaacgtgaagatgtccgtaacattgcaattatcgcccatgtcgatcacggcaagaccactctggtcgatgaattgttaaaacagagcggcgtgttccgtgagaaccaggaggttcaggagcgtgtcatggactctaatgatattgagagagagcgtggtatcacgattctttccaaaaatacagcgattacttataaaggaactaagatcaacgtcatcgacacccctggccacgctgatttcggcggcgaggttgagcgtgtccttaagatggtaaacggcgttgtgctggtcgttgacgctttcgagggcgttatgccgcagaccaagttcgttctgatgaaagcgctcgagctttctcttccggttatcgtgtgtctcaacaaagtcgaccgtccggaggcacgtccgaacgaggttgtggacgaagtgcttgagcttttcatggatctggacgcttccgaggagcagcttgactgcccgttcctttttgcttctgcaagagacggctacgcagtccgcgagcttgacgatctggtgaacaacaaaaaggatatgactccgctgttcgacacgatccttgactatatccctgcaccggagggcgatccggacgccaacacccaggtattgatcagcaccatcgattacaacgaatatgtcggacgtatcggtatcggaaaggtcgacaacggctgcttaaaagtcaatcaggaggcggttgttgtcaaccaccacgagcctgacaagcagaaacgcgtccgcatcagcaagctttacgagtttgacggtctgaacaaggtggatgtcacagaggcaaagatcggttccatcgtagctatttccggtattgcagatatccatatcggtgataccatctgcgcacctgagaatccggttgccattccgttccagaaaatttccgagccgacactgtccatgaatttcatcgtaaatgacagcccgctcgccggacaggagggtaaattcgttacctcccgtcatttaagagaccgtctgttccgcgaattaaacaccgatgtttctctgcgtgtcgaggaaacggacagcccggattcctacaaagtatccggccgcggtgagcttcatctgtccgtactgattgagaacatgcgccgcgagggttatgagtttgccgtcagcaaagctgaagttctctaccacacggatgagaacggcaagaagttagagccgatggagcttgcttatgtcgatgtaccggatgaatttaccggtgccgtcatcgaaaagttaagccagcgcaagggcgaaatgctgaacatgaaaccgattaccggcggttacacacgtctggagttcaacatcccgtcccgcggcctgatcggttaccgtggtgaatttatgacggataccaagggtaacggtatcatcaacaccattttcaacggctatgcaccgtacaagggcgagatcgcttaccgcaagctcggttccctgatcgcatttgagaccggtgagtccgtaacctacggtctgttttccgcacaggatcgcggtacgctctttattggacctggcgaaaaggtatacgccggcatggtcattggttcatcttccagagccgaggatatcgaattgaatgtctgcaagaaaaagcacctgaccaacacgcgttcctcttctgcggacgaggcactgactctggttccgcctaagattttaagtctggagcaggcactcgatttcatcgatgtcgacgagctcctggaggttacaccggagagtcttcgtatccgcaagcgtattcttgatccaaccttaagaaaacgcgccggcatgaaaaaataagtcgtatttctactcttaaaaaggagccatgtgcaccgtttcctatggtgcacatggctccttataaaatgcatatccattttttccgtttttcttcactgtatacatcgcagcatccgccgctgccagaagttccgttgcatccgctccgtgttccggccacaccgcgattccgagactgactcccagtgtctcgtccgcctctcccattctgcacggcttttgcagacgttccatcaaaccagatgcatatcgctctatgaccctgtaatcgccgcagtcgatcagtgctacaaactcatctcctgccaggcggtacggtgtgaaatggccatcctccaccgccagcgaccgaagtgccacttcgcgcagcacctcgtcccctgtattgtgtccgtaggtgtcgttcacccgcttaaaattatccagatcatacataaaaaccgtaaattcttccccggaggcaatccgctgcctgatatcttccataaagacactacggttcttaaggtgtgtcagtacatcataatgtgcactgtaagacagtttttcgtttgccctggtaatcacttcgttcattttgcgtcggcgcatattgtccaccgccagccatgccaccattgccaacgccacggcagcaatcaccagcgttgccctgatcgtatcccggttcttttcccagaaggtctccctgtgattgatgatgactgcatccccgggaagctttgatgcactgattccaaacctgcgcatcacattttcatcaaagcaatataccttcggcggctccatcacaatggagatccctgcacaatccgtgccctccagtatctgcaccgccatttctcctgccctttttcccatctgttcctgcgagacaatctcgccgcctaaaaatccttttcccataccgtgcgagacaattgaaaacatcggaatctgcgccacatcactcagcatctggatcgcttccgccgccgcgtacacattcccgtcgccatccctgctgcacataatatagaccagaatgctctcctcccccagcgcagcaacctgtctttttaattcttcctgggagagctttgaagcgtcgatctctacaaagtccaactctggaaaaacagtatcgtaatactggaattccttgcgttcgccctctccggtcaccgtatcatccagtattcctaccacctgtcttgcatccggatacagcttctttgccagcgtgatcgtattctcataagagagcgtctcaaccacgcccgtcacaagcggatctgctgccgctttcttcgccagttccctattattaactccctcaaaaacaaccggcgtctgcgcaaacaactcatcccgatacgtcattgcaaactgaaacgccgcatcatctcctacaatcacaacatcatacgccggaaccatcttcagatagtatgttagcgtctggtaaaatagctgttcactctccgccgtctcgacatttttggtatccataaactgataatccagctgtacaccagcgcccaatgcttcttttataccgcgaatctgttccggaaccgtctcccatgcataggaataggaactgataaataataccctgccggtgatttccccagcgtccggcaccagttcttctgcatatgccggaatgcctcccacacagataagaagtgcaatagcaaaaaaaatccggtaccctttttgaatccatcgacgttctatcacagacactcctcctccctatccgtatatcaaaattttccaccctcccgcttctattgtcaatattttttcactgtttttttacggttttctgatattttacaaccgccggatccgtcatctgcagcgtcctcttccactccctgctttcccccactttctgcaccgcggaacggttcttatataaaaagcgcgtcagattatagcagtccacccagatctcgttgtttccctctttctgcgcctcgtcaaagatcagctgcagcccgaaatgcagatgaaccgtgtctatgttgttgacattttccttcgtgctgtacccggtatgccccatatagccgatcacgtcccctgccgtcacgacatccccctccttcaactgttcccggtacggatagttctggcgcagatgcgcataataatagtaacgcttcccgtcaaagctgcggatgccgatgcgccatccgccgtactggttccagccgatcgcttctacgtagccggattctacggcgatgattggggttccgacctgccccatcatatcatgccccagatgctgcctctgatacccatagcttcttgacactccgaaatcatcataatcactgtactcaaatcctttggcgatcggtgaaaatgctttcagaccatacttttttacatatgctcccccctccttttcctgtatctcatattcaccgaccataccgccaaaaaccgctccgtatgcctccctgtagtaggaaaacatcttcatatccgcggtcatatgctccattgtatcctccccgcagagaattttttcagcagcggtacgcatgtcctccgttgctccggctccaaaatctccgccgttctttgccccggcgtacgccagaagatctatccagtcaagatgctgcttttctccgtaactacttacgtcataatcatatgccctggacaatgcctcataggacacgttaaaatctacccatttgatatagccgtccgccgttgtctccacgactgatttttccggcagttttccattctcccagaggattactcccatcagaaaaagcagtgccgcctcaaggatcactgccgagcgtatccgcctgcttttctccattcctttctgctccgttttccattcctcactgtcatggtcattttgttcattatataaaaaaagactgcagactattcctgtctgcaatctttacagataccgtataatatggaatttttgcactgcagctgaaatccgtgatccttttgaatgtgctctgcaatctcatccataaatccgcagtcgagatgaatgatacatccgcatttgacacatttcagatgaagatgctcatcgcagtgctgtcccagttccacgtactgatacactgccttgcctcccgcctccgccacatatttcatgacggtaccatctgtggcaagcttatccagataacggtaaatcgtcgtgatattgacggcatcgccatttcgcttcagatattgatcgatatccgccgctgtcacggtccggtcactgttgctttttaaaaaatcaagaatctttctgcggctgtttgtcgcatatccacttcctgccatctcatccctccgcaactgcatctattttcattatatcatcttttctgcgccgacttctgcgcatccgaagttccgcaggaacttctaatatgaactcgtcagagttcattatatcaactacgcttcggcaaaagtccggaaaaactccgttttcccggactcgcgggcatgttcacatggaacatatccgcccgacgcatgcaagcatgcgcgtccgtctttgctccatgctcacttttgccttcgcgaacattatatcacatttttacgcttcggcaaaagtctgtgaaaccatatccctgtctcctaaaatacaattccacatgcttcaatcatgacaccccagagcacaccgagcacatacatggtagcgatgatggccgcattctgcttatagtcgcggttcagccggaacagtaccagaaatcccacaccggcattcaccaaaagtcctgccatcatggcgcccgaccggataattccatccagatacaactgtgtgattacaacggacgacgcacagttcgggatcagccccacgagggcagcaatcagctctcccacaaccggaagtccggaaaacagtcccgccagcgtttcctctccgatcagcccgatcacaccgtttaataccagtgaaatcaggaaaataaaacaaaagatctttaccgtatgcttaaacgcggaaaccacaatcccatcctcgcaatgacaatgctcctcctcacacacgacatgaatatccatctctttttcctgcttcttcaaaagtctcacatataccagttccacgatcagaccggacaacacggcaatgatcaccttactgccaagaattttcacaatcgtcgccaccggcaccgactccgaaatcagaatcgggagcatctcatccgaagtggacaaatagatggcgaccagcgttccgactgtaatgactcttccggcaaaaagactcgatgccgctgccgaaaacccgcactgcggaatcacaccgagcagaccgccccacacaggtccccattttccagcggactgtatcttccggctcagcctgcttcccgtatgatgttccaatgcctccataaaaagataggtcaaaaataaaaacggcaaaagcctgacgctgtcaagcactgtatccaataatacatccagcataaaatcattcctccctggcgatgcagcatcgccgcctgatatactgtcttccctgcatgatgcacacttttgcaaatcattcgtttttgcaacctgcatgcatttgcaactcatttgcattttgtattatacattgatatcgtgttttgtcaagctttttatcgtatttctttcgagtgccatatttggcaccacactgctgcccggctataattccatccattctttgtgctgcattctacacaaaacaggaagcagactccgttcaggctcatatttgaaatccatccagataccctctgtccagatacagttctcttaatttttcgcggtacacttcctttgtattgtacggtctgccaaaatgaattccgtccgaaaactggtccgccggataataggtaatttcagaaaaataatccgggaaaagccgctccaatccccgtgtttcaaaatcctgccggatctgctccacctgcttgcggcgcgccggtgtatctgccagcggatcggggatcagatagcatgccaccccctgcgtgtcgcacaattcgtaaattttccgcagatagcgctctgccagatcagacatgccgtctgtccggtcatctccgcttttccccttcttcgccgcttcctcccgctccttcacataattcaaatacagcttgcggtttaccgccgaaccggcgatcagttctgccaccggctttttcaggaaaaagcttccgaacgtctcctccatttcctctgcggtctcctcgtcaagttcgcccagcagatccgcctgcaaaaacggaagaaccacataagaatagctgtatgtggcatcaatcgacgtctgaagcagatccggtcccgccatcagccagacttccgagacattctcatgcgtctccagaaattcttttaccagaagatattcccccgccatggtcagcgcgcgattatttccgaccagacagtattgttgattacaatcataaaacgcttccgtcatctgtgcgcagacactgtcaccgaccaacagcttcgtgtaactgcccggcgttctgctctttgcaagatacgcagccacttcccgctcggctccctcctcgtaatcactgctgtccgtcaacgcggcaaacacaccgcgaaatctctccgtcgccgacaacagatcaaaggtcagaagcagtaccgcaaatattcctaaaaaggcgatcaacttttttgtaaaacgcttcatgccttcctcctaaaattgaaaataaagaaactccgccgccgctcttccgtaattctgcagcaacagcacgacaaatcccagaagaaccagcatgtaaatactccagcgaatcacaagcacctgctttgcaagccaggcacgtatggaaatcccggattcatgcaggatatccactacaagcagaactccgatggtaaatgccagctgatacacctccagtctgcaaagccccatgccaaataatgtgccatcggtaaactgtcccagccagttaccgttttgcacaatccgccgaagcatcgccacagctcgtcccagatgatctgccctgaaaaaaagccacgcaaaatccgtgaggataaatgtcacacaaatccgggcagcgcgcgtcagtccctgcattttttccgaaaaaaaacgtatctttttctccggcagcctcttttgcgcggcctcacttacatatctgatgcctctgccagccacctgatagcttccatggattgctccccacaccacatagtgccagcctgcgccatgccagagcccgctgacaagaaatgttatcatcaggtttacagcggttctcccactgctgccgcggcttcctcccagcgggaaatacagatagtcgcggaaccagctcgagagactgatatgccatcgtctccagaattcccggcaattcactgcaaaatagggctgtcggaaattatccatcaggcggatgccaagcacctgcgccgccccgatggcaatatggctgtaaccgccgaaatcacagtagatctgtaccgcaaacagcaccgtggcaaacacaagcatgccggaggaataattccggtaatcctgatagacctgatcgaccagaatcgcagcacgatccgcaatccacattttttcaaaatacccccacagcatcagaagcagtccgtcctttaccctgtcatagtcaaactctgccggctcccgcagctgtgcaagcagactgctgctccgctcgatcggccccgcaacaagctgcgggaaaaatgacacaaacagcgcaaaacgcaggaaacttttttccgcttctgtcttccctttccagacatcgatcaggtacccgatggtctggaacgtgtaaaaagatattccgaccggaagaatgagatccggcacccttaacgcccgcacgcttcccaccgcacggagcaattcgttgatattctgcactgcaaaagcagaatatttgaaaaaaaagaggattccgacacacacaagcacgctgccggtcagcaccgccagacgtctcttcccttgtcgtactttattttgtgccagcaaaagtccgcccccataaccgattgcggtcacaagcagaatcagacagccatactgcacattccagctcatataaaaataatagctcgccacaagcagccataactgttttgccctctttggtatcagaaaatacattcccgtcaccagcgggaaaaacaaaaggaatgaaaacgaatgaaacagcacttaattctcctctcatgaaatcaacagatgcctttcctaaaatcctttgacgcaatacccgtcagcaaattttctcaatccggcgttctttgtatttgcaaaaaggagacacggtcttcacttgccatgtctcctctgtctaatgctttttgttgtgatgttcctacagcatcttaatgcgctctaacgctgccagtgtattctcatagcttccgaatgccgtcaaccggaaatatccctcaccgctcggtccgaatccggaaccaggtgttccaaccacgttggcgcgtgcgagcagatcgtcaaagaattcccaggatgtcatctctcctggtgtcttcagccagatatacggcgcattcacaccaccgaacaccgtgtaaccggcatcccttaatccctgcttgatcgctttcgcattcttcatatagtaagcaacctgctcttttaactgtgtctttcctgcctcggaataaacagcctctcctgcccgctgcacaatgtacggcgcaccgttgaacttggttccgtgacgtcttgcccacatagcattcagcgatacctcaccgcactttaattccttcggaacaaccgtataacccagacgcaccccggtaaaaccggcattcttagagaaactcttcagttcaatcgcacaggtcttggcaccctcacactcatagatggagtgcgccacattttcctctgaaatataagcctcatacgctgcatcgtaaataatgaccgctttgttcttatttgcataatctacccagccctgcagctgatcttttgtgatggtggtaccggtcggattgttcggcagacacagatagatgatatccggtgtctctttcggaaactccggcacaaaattattctccatcgtacacggcatgtagatcacatcgctccacatctccgtctccggatcataagtaccggtacgtcccgccataacattggaatccacatataccgggtagaccggatcacacactgcaatgcggttattctgtgcaaaaatctcctgaatattaccggaatcgctctttgctccgtccgatacaaaaatttcatcaaccgtaatatcgcatcctcttgcctgataatcgttcttcacgattgcgctgcgcagaaattcatatcccagatccggtgcatatccgtgaaaagtctccgcatgccccatctcatcgacggctttatgcatagcttcaataattgccggtgcaatcggctgtgtcacgtcaccgatgccaaggcggataatctttttgtccggatttgcttcgctgtaggcatttaccttctttgcaatcgtactgaaaaggtagcttcccggaagtttctgataattatcattgatcttgtacatgtctctctccttattccttccatgcagaattcgttctctttcaaaatgtcgccaacgacacaacgcattgccactctctgtcacccattatctcatacttaaatccaatccgcaagcactttttgattcctggtaaacaaaattctcctgtctgcgacttttcctattcgcacgggtatgcatccccgcggagcgtttttgtataacaggaacgatatttcctattacaaaaaaaggaccgccgcatctgcggcaatcctctctctcactcatcaggcaagcaaacttaaaatcatctgggctgtttctgtcagaccggttccattatccatgctgcgtttctgtatgtaccgatgcgcctcttcctccgacagattgttacgttccatcagaagtgcttttgcctcatttatcagctcctgttcctccttcgtgcgctccttcggaatctgcttcaacttttttctgcgcctggtgatggtatattccatcatctccaccgtatctaacagctcgtttaccttaagcggcgtggcaaggcagaccagattctccacatcccggtttccacagtttgcaggagacgcaaccaacagcatttcaaattgtaccggcagatattcgtgcagttctgtgtacatcatatccacaaaacgatacccgcacacgacaatcccgccgccaagttcaccggcgctctgtaacacctgcgctccggtgctgcagactgcatcgacatgatgaccgttctgcatcagtatttttttgatattgcgggcattatcctgtttgggaaatgcaacaataatatttgtcaattctatcccctttgcatccaggctctatattttataaaggtaattgtcaatttcccagcctgtcacctgcgcacgataatctgcccactctgccatctttgcctcgctgtacttctcgctgatatgttcgccaagtacttcccgaatgtaaggatctgccttaaatgcttcgaccgcttctcccagatccgccggaagtgattcgattccctgcttcttaatctgcgacagccgcatctcgaatatattctcagtcacggcagccggcggatcgatctgccggcggattccatccagtccggcttccagacacaccgcgagcgtaagatacgggtttgctgccgaatccgggcagcgcagttccactctggttctgctgccgcgcgataccggaatccggatcagcggactgcggtttgtcatggaccatgcgatataaatcggcgcctcatatcccgggacaagacgcttataggaattgacaagcggattggtaattgcagtcatggctctcatatggttcataatgccgccgataaaccagtaagcttccctgctcagtccgttctccccgtccggatcgtcaaaaatgttccgaccattcttggaaagcgacatattcacatgcattccggaaccattcaccccgtacttcggctttggcataaagcttgcaaacatgccgtgccgctttgcaatggtctttaccgcaagcttgaatgtcatgatattgtccgctgtttttaacgcctcgtcatatttaaagtcaatctcatgctgcgccggtgctacctcgtgatgggacgcctctatttcatagcccatatcctctaatgtcagcaccatatctcttcttgcattctccccgagatcaaccggtcccagatcaaaatatccggcacgctccgtgctcatcgttgtcggctgtccatcctcatcctgattaaacaggaaaaattcacattccggcccgacatcaaaacggtatcccatagattccgcatctgccaccgccttctttaaagcataccgcggatctccctcaaacggtttgcggtctgcggtataaatatcacagatgattctggcaacttttccctgctgtggccgccacggaaagattacaaacgtatccagatccggatacagatacatgtccgactcttcaattctcacaaatccctcaatggaggacccgtcaaacatacattcattgttcaatgctttctcaagctggctggacgtgattgccacattcttgagtgtcccgaacatatcggtaaactggagcctgatgaactccacatcctcttcctccacgattcggataatatcctgctttgtgtacttgctcattttcttctcctccatcttccactgccatgatctttcctcactgccgtgatcttttctcactgtcgcggtctttcctcactgtcgtgatcttttctcactgtcacggtctttcctcactgtcgtgatcttttctcactgtcaagttccttcctcactgccgtgatcttttctcactgtcgcgattcttctcctgctatctgcaatattctgtaactttttcaaaaggcatcgatcctccgaacaaatccagtgcacttccgatcgtcacattcagcctgtcacatccaagctctctcaaaagtgcaaggtcatcaaagtcccgcactccgccggcataggtaaccggtatcctgccccaggagccaagcagacttgcaagttctctctcaataccgtttgccttaccctccacatcgaccgcatgtactaaaaactcgtcacactcactgccgaggcgttccaaaagttctgttgtcacacgttccctcgtatctttctgccagcgatcggtcacaatataataaccatccgcccgctttgcacagcttagatccagaaccagatgttcttttccgacatttttcctcaatgttgcaagccgttcatagtcaatttttccgtcacgaaacacataggaggtgacaatcacatgacttgcgcccgcatccagaaactgctttgcgttcgcagcatcaatgcctcctccgatctgaagtccgcccggatactccgcaagcgcctgcagggcctgtgcctttgtcgcctcatagtacgcactgtctcgcgaattcaacagaatgatatgtccgccgcgaagtcccgcttccttatatagatgtgcataatacgcagcatccgctccggcgacaaaattctccactgcccggtctccctcatccgcaagactgctgccgacaatctgcttgaccttgccgttatgtatatcaatacagggacgaaactccatactgcctccttatacactgctctcgtaatataaatttaggcaacgtaccccctgtaacagtggctccgtcgcccactgccatcatagcacacatctgtccgtttgtgaatatttttatatattagtctaacttatcaatatatttttttatcaactgacacttatactacattgacacacacatttttttttgctattatagagaaactaatatacttttttaacaaacatttatacaaggaaagcgaggaaaataaaaatgggaacaattatcggtgaaggaattacttttgatgatgtgcttttggttccacagtattcagaagtaactccgaacatgattaatttaacgacacaccttaccaaaaaggtcgtgctcaatatccctatgatgagtgctgcaatggatactgtcacagagcacagaatggccattgccatggcaagacagggtggtatcggtattatccacaaaaatatgtccattcaggctcaggcagatgaagtcgacaaggtaaaacgttcagaaaacggcgttatcacagacccatttttcctttctccaagccatacactgcaggatgctgaagacttgatgcgaaaattccgcatttccggtgttccgatctgcgagaataacaagctcgtcggcatcatcacgaaccgtgacttaaagttcgagacagatttttccaagaagatcagtgaaagtatgacttccgaaggtcttatcactgctcctgaaggcattaccttagaagaggcaaaaaagattcttgccaaggcgagaaaagaaaagctgccgatcgtcgacaaagattttcatctgaagggacttatcaccatcaaggatatcgaaaaacagatcaagtatccgctctccgcaaaggatgagcagggtcgtctgctttgcggtgcaggtgtcggcattaccggcaacatgatggaacgtgtggaagctctcgtaaaggctcacgtagatgtcattgttgtggattccgctcacggacattccagaaatatccttgaggctgtcaagaagatcaagaccgcttatccggatctgcaggtcattgcaggtaacgtggctaccggagaagcaacacgcgacttaatcgctgccggtgcagatgcggtaaaagtcggcatcggacctggttctatctgcaccacccgtatcgttgcaggtatcggtgttccacagattaccgctatcatggactgctataaggttgcaaaggaagccggtattccgatcatcgccgacggcggtatcaaatactccggcgatatgactaaagctctcgcagccggtgcaaatgtctgcatgatgggaagtatctttgccggatgtgatgaggctcccggaactttcgagttgtatcagggaagaaaatacaaggtttaccgcggcatgggttctcttgcagctatggagaacggcagcaaagaccgctatttccaggaaggtgccaagaagctggtaccggaaggcgtcgaaggccgtgtggcttacaagggcaatgtggaagacactgttttccagctggtcggcggtatccgttccggtatgggttactgtggctgcccaacgatcgaggatctcaaggaaaagagcaagtttgtaaaaatctccgctgctgctcttcgtgagagccatccgcatgacatccacatcacaaaggaagctccaaactacagtattgacgaatagacattttctttatataatgtcatttatattacactttcgtattccggcgccctgtgtgccggaatactattaaccaaaggcatgacacatatatctgtgctcatcctgctatttaatgaggtgaacatacttggattcaagtgacatatttcaaataattttcttagtgctcttacttatgctctctgcattcttttcatccgcagagacggctttaattaccgtcaatcgcatccggatgcgtaccttggcagaagacgggaacaaacgcgctgccactgttcttcgcatcacagataattctggaaaaatgctttctgcaatcttaatcggtaataacatcgtgaatctgtcggcatcctccctcgcaacttctctggcaatcaagatctggggcaatgtcggtgcaggtattgcaaccggtatccttaccattctcattttgatttttggcgagatctcaccgaagacactggcgaccgtcaattccgagaaactggctctcacctatgcaaatgtgattgaggtactgatgaaacttctgactccggtcatttttatcatcaataagcttgccaaccgcatctgcaaattatttggtgttgatccgaatgccgatacccagaagatgaccgaggaagaactgcgcacgatcgtggatgtcagcaaagaatccggtgtcattgagtctgaagaacacaccatgattaacaatgtgtttgattttggcgatgcacaggccaaagaagtcatgattcccagaattgatatgacctttgcgcaggtagacagttcctacgatgagctaattcagatttttcaggaggataagtttacccggctgccagtctatgaagatacgaccgacaacgtgattggtatcctcaatatgaaagatctgcttctctgtcgcgacaaggatcatttttctgttcgtgatattatgcgtgaaccgtattttacatacgagcacaagaacactgcggaattgtttatggaaatgcgtaagtcctctatctcacttgccattgttctggatgagtatggcgctactgcgggtctgatcacgctggaagatcttctggaagagattgtcggtgaaatccgtgatgaatatgataccgacgaagaagatccaattgtccagcttagcgaccgtgaatacatggttctcggctccaccaacctggaagatctctgtgatgaaatcggcttgaattttacatccgaggattatgatacgattggcggctacctcatcggtctgctggatcaccttccggaaaagaacgaagtgattattaccgatgatgatgtgttgcttcgtgtggaacagatggataaaaaccggattgaaaagatctatatcaagaagccggaagctccggtctcagatgcagaagaacacacataagggctgtccgtaatcaacaagaatatattaggaaacattctctccactcttcctcacagaagaatgaaagatctacagccggcggcaggcaggaaacgcctgccgccggctttttttattttcatcttacacgatttggcgcaagatactgatcatacattccctgtaatgctcctgcttctctgctatctccgaatccgtgtgcatctacatactggcggatcttccggcgtgtctcaccattaatcgtataggtttcaaccggtgcatcattttccagattttcaaacgccgtccgaagtgcagacacgtacgcagtatccgtcttccagatcgaatcatccaaaagccctccccgttcataagaacttccgtaatatttttcatcaataaaacgtgtcgttctctccgttcgtacatctgcaggcgttgtatccaccacataaaccgttatctgcttacaatagatactcccggcgctgtcaactaccataagattttccgtacagcttcctccacgcaaaaactgagtaaaatccgatgcctgataatccggaatcgaaaaagatgttccattttcatgaaatcctgcctcgatcgggcttccatcttcacgatccgatgcagtcgcatggcttaaaatctcactgtctgtgatacccccctgctgtgcctgctccagtgtatagtagagatttgtggcaacaatccacggacagtcatcccacgacgcatacagcgtgatcatcgcaccgttctgatctgccacgccggatgcttctatcagatccgccacactgacctgcattcctgctgtccattgcggtataaagctatcgcgcccatcctcgagcgaccaccccataaaaacagccgcatatgcctttttatccgacaccggatcagcagccggagtttccgattcttccagaacttccagttcttccacatccgcttctgcttctgttgcatcttcctccggtgcttctgtcgattcactggaagcatccgcttctactacttccggatctgctacgcttccatctgaattcgtgatgcttccatccagctgcgtaatacttccatcctcatttataatgccacctgccggtgtcatcatcagacccgtatccgcatccatcaccataaccactacgccagaatcatccaaaacaatcgtgccgtctaatacctgctgcgtgatatcctctccgtccaacgtatagcggatataacgtcccgtagcatccggcaacgtcacattctgatcgtacatgatcgttatatcatcaatcggcgcttgttctttgccatcgttcggatcaaaatgcagcgtataactgtttgctgtccaagacgccgtcagaacatctgtcgcatcatcttctgcgccaaacgtatacaccgcattgttcagactaccgttaaatggatccgatttcacccagcccgaaaaagtatatccggttcttaccggatgcagaatggatttagccgttccatagtgctccgtaaaactctgcacagcggtacttccctgccatgttcccccattgggatcaacttttaaagttgagtggttaatctgcgcatttgcagtcattcgcacattttgtacaggcatggcaaacgcatactgctttctatccgtctcatacgtgccagtccatcccgtccaatggtaaccattttttaccaccgcatcaattgtaaccgctgccccagacatataattgcgtacaccactgacactctgaattccatttcctgcaatcagatcaacccggaataaagcattgcaccagctggatgcaatgcatgctttgtcgatccagtgtcccgtgtcaactcctgcagattttaaatacccatcaagttgatccctgttatcaaaccgactcataccggatccgctgatccggcaatagatcgtatactcaatcttatctcccttaaaccaacttgatatgccaccaccagaaaagataaccgtattatgtactgtcccgtccgcacccgtcaccgtaccctgcctcacagtagcactggacacaatattgctatttaccgcaatgttgtaattcgtcagatccggagtcagattcggatccagtgtcaccgtcagttcgccgtcaaaaagaccagtatcatcctgtgcagatgtattttcaatcttcccttttacgataacctttccatccgatatacttgttgtctgctgcgactcaaactccggaaaagcaatgtctaccgccgctccgatgtaaagctgggtatcccaacggacattggcaacatccaccccaaacactgtcgcaccatatgataatcccgaaacgttatacaaaacggagcacatatccgtttgttggcaaaatagtgatccatcacggtaaagcccctctattacagtcccgccgttccttacatttttttcactatcccgagcttgttgtgtaaacatggatatcagtttgggattttccgtaacccttgccgcatcgatacatccaaaaagtatctgtcctgtcacgtctccgtattccttggtttttaaaccatcaaacaactctgcctgcatcgtaacagttgctctggagacaggatcgaaaccataatcatcgccctcccaatcaacatctccgaaccggaatctcgatcccacacttaaagtcaccgcacgtaccggataagaagcattttcctccacgacaatcagctgccagccggtcggcgttccaccgcctcccgtatcctgctcccagagatcggatgcacggcataccggtatattggctacatagtaatcaccatacccgtatgttttaacgatagttgttacatccgcaacgttgcagtaaattcgggggcgggactgctcccatccagaaacataccgcgaactgcgatcgtctacatagacccaatcaggataaatgtttgctcctgatcttccgtcgtgcatgatgaatgttacatgatttgcattactatcatctttgttatatctcttccgagtttcccatatcaaatatgcttttacaatatgagtcgtgttattatcaccatgtagcgtcgccatcgaactattagaccatcccagtaacgtctgactacaataagattcatcatcatatctcggtgacggtgaggaatagacatttatattgcccgtgtaattcaaagcatatctgcctaccgtagtattctcatcattttgtcctactggcaaaacattaaatacatttttttgtatctcacttgccgcgccttctgccaatgttcccgccataactttatcagaaaataataacgcacttatcacaaacaatacgcataaaataatcttatatattgtacttctgtcgtatctgagcttgcgctcactatacatataattatcctccgttatatctaattaaatgtgatcgtggaatttcccccgccatttccgccagtcccggagttatctccaagtgacggatctagtgggataaaatcatctggaactgacatcgttccatctgaacttgaatttccaccgttgttgcttccagtgtctgcacttggtgtggagcttccagtgtcggtacttccgctgtcaccactcggcgttgtgcttccattctcgctgcttccggtattattgcttccgctgttgctgcctccagacgttccactgttgctatttccggaattgctacttccagatgttccgctgttactgtttccggaattgctgcttccagatgttccactgttgctatttccgaaattgctgctttcagatgttccactgttgctatttccagtattactgcttccagtatttgtagcactgctgttggttgatccggtttcagcctttgttgtctccgactttgttgtagcagatttggtatccttcttagaggtctttccatctgcaactgtcaccttagcagtctgctttgcagtaaacccgttctcatctgttaccgtgtaagtaatctcgtactctcctgccaaagacaggtctactttgctgtcatcacattcgatcttatctgtcagatcattcccattgctgtccgttgccgttacacccgaaagatagtccacattctctgctccggttgttacggtaagatcctcaattcccaaaaatgtcggttctgtaccaaccagtaccggcacttctacctgcttgctatttccactctcatctgcgagtgttaagcttacactgtactcccccactgtatgaaagactatcgcgtcatttgttaccgttacatcgtctaacacaaatgtttccatatcttctgacgctccggtggcctctacttcctcggtgacctccatgtcctcagtggtctccacatccttggcagcctctacaccctcggtagcctctacaccctcagtggtctctactttctcggtggcatcggtagactcatctgccagatcgtcaaatgttgccattacattcccggtcagctcggttacactcgttaaaacatcctccacgtacaatggctcgtccacaccgactgtaacctgattcaccacctccgcctccggcgctgtggtatctactacgtccacttcaagggacgctgtctgatccttataagtaaccactgccgtataagttccaagcttacttacatcaaccgccccaaaatcaattgttgtctccactgcgatatccgcatccgccacataagccgctacatccgtattaagctcataccccagttcgacacttaccctatctgttgcaagcgcaagctgcttatctccgcaacctgctgctgtcatttctgtcaccattgttactgttaataatactactacgcttttctttttcataaactaatctccctgattcttataatttccttttctgtctttgccgcttccctttaaaaaacttcattcataaatgcttccaccagtttctcatagctcctttcacttgaatccaattctttgaacacttgccatacaaatcaacactttcgttcgcttttaaagaggcatatctactactacattagtatacactacacagtacgttttttctatatttttataatctcagctacgcttttaatgcttccctctatcacttccagttaaccctctttttaccgattctctctgtagatcgtatcatcgcattgataatatagtctacaactgcctgtcatgatccggtgccacgatctgcaccatacacatttgccgtattccctgcaattcccatatctattcccaggcggcataataatcacgattttcttctatcggctgtgaaaagtccgccgcgtaatcattccagtcatgccagccggcaaataccacaccattgcctcccggttctgccggtggctgcagacattgtccctcctccacggtatatactttataacagcttccctcaccgagcattccctcccggttctggtaaaaccgcacccggtactgctcttttgatacattctccctctcttcccggataattgttctgaccgcttctgccgtaccttccattccattgggatgttgaaacttttcctgtaatttcattgacaatacccccttttgcacatcattctgatagaccttcaaaaccacatcggagtctgtatcgatttccgccgccagaagttccacacactccgcaatcaccaattctccggaagaacaccccgcctccgcaaacggcatcccctcgaccgtcttttccattgtggaaggaagaatcgtctccacctcacatctgcggttcatgcttccgccaatcgtcagcacaatcccgagtatcagaaatcccatgattgcactgacaatgatcatcgctgcatttttcacatatatctcctttcccggctttctgtcttctcatcggttcacaggtatctgaaactcacagacgcttctgcggtttgcttcgtctgtcgcgcagacccgcaccgtatagatcccctccacatcaaacacaacctcaccttgctgtgattctattgtgcagctgtttccatgcggatctgtcatctcacaccacaaaacactccgttcttctcccattccgtctaccgcagaaaataagtctcccggcagatatgctcccctgtgcagcataccattgtacgcataccggatcgtggggtacgccacctcccccgcctccgcaaaagcgtcaatggcagcgttttctgtgattgtctcttcctccggtatccatgtctttacgatgttaataattccccggttgccctgctcgtcacgaattcctgcaaacagcagtaccatgactgctatcagcacaattcctgccgcaattccctttccatagcattgaagtacctgctccatctgatcacctctgttcttttcctgttggacacttaactcccacagattcccgtcatataataccgcaggaccataccgatcatcccctgcccatccacggcatggaagaataagagcaatgcccctattccgcctgcaatctgcaaaaatccattgccataaacctctgcgatctctttcatctgtacgctccttttctctgacacgtccgggcacgaaatccccctatagcatgccagccacctgcatccatatctcctgaattgccgtgcatccaaaccagcccaccagcaataccagcattgtcattccaagttcttccagactccattgcatcctgctcctccttttaccgtgcgattcctctcgtcacccgctgctgcgagacccctaacagtggtatccggtatctataatagagattgatccccgcaatcctgcggtcgctttgtccaccgtaggtgtaggactgcacttccagttcgtacccttctgttcctgcctgcgccttgcagccatcaatcacgtacggattaaagtcactgttctcaatttctgcaatcattgcagctttaaattccttcgccgctgccacatcggcactcaccccgagcatactgatgcacagcagcagattaaaaaccagcaccagcatcacactgaacacttctatgatatatttcactcacgcacctcccatgcctccaagaacctgcatcatcaacgccattccgaccgtaagatctgccagcagttttccagtggctgccagcaccggatatgcaaaaatcaacttcatccggaatgcacgctcttcactgcgcaaaacatcggcgcgctcctgcatcagaaccacacgctcaatcagatgattcatctgcacatcaatatctcctgttccgttttcagaaaaagcatgcagcattttcatacagcttaacatctcggggagatcaaactttttgcaaaagtccgtgtatgtctgtaattgatccggacgctcgtccattctcgcgcaaagctccgcaagttcgctcccgagcaccgccggggcatgttgtgcagattttgtaatcgccatctgaacgttattgttctgtaaaagtaataccatctcaaaaagccagcgcggcagcacctgatacaattccgccgtcacgtcccgctcggcaatgcggtaactgattctcggctgcattgcaaccagtaaaccagtcaccagcaggagtattcccgcaatgcgccatcccacagtccaaaacacaaacgcagtcatagtcacaattcctgcaggaatcaggcgccgatactgctgtgctttcttttcataccccattaccagttcatagctgtgtctgatatatgccgtgtcatacagcggcttttcctccagccagtcagccgtcaggcttctgacactcttcacataaaatgcaagcagcaacaaaagaaacaccatcgaagatatctggatcacaggaacggtaaacaccgatacgtcaacctctgatgtaaacatctcctgcatctcatttaaaagatacaatgcagccgcgcacaagagcactgccaccacaatggaaatcacattatctgtatgactcttccgcttctccgcctgaagctggtatccacgctttttgaaccgctcaatatcctccagaacaagcgtgaccgatgcctccacatccccgccatattcctccgtattcagtagaagttcatgtaccgtcgccagcttatcacaggcataataccgttcgattttctgtaaaccctcacgcagaacgccctgctctccgaccggatgcccgtactccatatgcgcaatcgcttcctccacacagagtcggatctgtccttccccaaaaattccgcgcacctccttcaatgcactcacgatctttccggtcttctgaaacgcatagagcagctgttccatgtaggcacatgcatctccaaaacgcttctgctcatacattttcttatacatatcaagtaccagtaccgggaatacgaaaagcactgtcaaaagcacccctgccaaaaacagcggttttagctgaaacaccattccaatcccaccgattccaaccagagcggctatcaccgccataagatgcgtcctccacgaaaaacgataaccgtacacatgcacttcgcgctgcagatttttcggattcaacagccgcagtttctcccacagtccttctcttttcatctattttccctctctcctgtatctctgccagtgtgcgcagcaaaacggatcctctattcccgcctgtccaaggcgtctcacaatcgcaggcggaagctcttccgagagcagttccccatcctccagtatcatataaatacgattctcatactgctccctgctgtaaaaacacagctgatccatatatcttcggatctttccgtccggctgtctgacgcagcggatcagaatccccacattcacatagcggtagatccggttctccatacgctctgcgtcacgcgcatcgctcatcatattctgaatgcgatccggaagctttctgacatcatccaggtggatcgtcgtaaagccgctcacgccggtactccactgctcgagcagcgacgtcacctccaccgaccttgcctccgagaggacaagccacttcggattctgccgcaggctcgccttgatggcatccgtgtaggaaaaatcttctccgacacgaagctccaccgcatccgcccccggattgatgtcccggtaatggatctcgagcgaatcctcaatcgtaattacccgctcctcgcgcggtataaactgcataaagaatttcgcacactccgtctttcccgcaccgggttctcctccgaacacaaaattcatgcccgccaacacacagttcatcaaaagctgtaaaatccgttccgggcaataggattcttccagcattctctcaatgttcatgcgcaccatgctcggcgacttccggatacagatactggtgccggatgcggccgccgcctcatggataatactgatacgcagttctctggtatcagcctccagcaccttattggcattattgaactgacgattcacgcagttggaaatattgtgcgtaaaagtgctgataaatgcatcggacagatgctcttttacacgataccttccgatctttaagtccgtaatccacaattcgcttccgttgtagtccacatcggtaacattcgggcgctgcagatatttccagaaaaccccaaactgcgcttccgttggttcaaacgtcatgatctcccccatgtcatcctccctatggcgttaagccattcatgcgggaaaagaatcccgtcagcgcattcttgaactccgtcgccacatatccgtccgaggagagcgccgcaataatgattgcgccgagtgcaagcaatacaataattgcaaggattgcatttccataatgtttcattacctgttccataataatttcctccttcacccttctgttgtgtctttttcttttaccaaacatgtccggttttatcgatcttacatacctcccttaaaatacgatccgccgcttttactaatccatcgataaactcctgattcctgctgcttctcgcagacccgtattcctccgctataaaagagctgcccagtccgcgcttcaatgcacagtcatacgctgcattgtaccgcacgatgccaatctgcccctcatccacccgatatactctgtttagcacatccggctccggtgtcccgatgcagttggcatacagatacaccatgcgcttctccagatacatatggcgcaaaaagaactgctccattccgtcgtaatcctgcggttcaaaatttaccaccacaagatccgctgtcaaaaggagcttcttttgacccgccggactgcacactcccgcatcccacaaaaagagtgccgaatcctcgcatcgctccctctgcaggctgccgcacacaatcttcctgtccgggcataagtgcggcaaaatgcctgccattgcagtatagttcgccgtcgtaccgctccggtgtgtttctccccaaaatacaatattcatttgttcctcacttcactctgtgctgtgtgattgtccttactggaattatggatgaaactgcctccatatagcgtgatacttagaaatgtggataaaatccaactatttgataaaagatgtgcttattttacatcgttttcttacatatgtaaatagcatttttcaaatttatattttttttagaaattactaccggaaacttttcttttcgcattgcttccattataataaatacaaatacatgtatcaggaggtcttatgaataattttatcattacaaccgataccacatccgatcttccggctgcctatgtagaacagcatcagatcggcatgctttctcttacatatacgattaacgatactacttattcttgggagcatccgcttccggtaaaggaattttatgactgcatgcgtcagggttctcttcccacgacctcccaggccaatcccgaggaggctgccgctgtttttgaaaaaataatcaacgaacagaatgccgatattcttcatatcgccttttcttccggtttaagcggaagctacaacagcgcaaggctcgcggcggaggagctttccgaaaaataccccgaccggaaaatcatcgtcatcgattctctctgcgcttctctcggcgagggacttctggtgcacaaagccgtcaccttaaaggagcagggacatacactggaagagaccgcagactggcttgagtcaaacaaacttcaccttgtacataatttcaccgtcaatgatctgtttcatctctaccgcggcggccgcgtgtcaaaaaccgctgcttttctcggtacgatgatcagtttaaagccgcttctccatgtggatgatgagggacatctgattccgctctccaaagtgcgcggacgcaaaaagtcgctgattgctctcgtggatgccatggaaaaacagatcggcagctggcgtgacaagaatgacatcattttcatcagccacggcgactgcattgaagatgcacaatatgttgctgatctcatcaaagaccgtttcggctatgaaagcttcctgatcaaccatgtcggtccgaccatcggcgcacacacgggtccgggcgtcgttgcactgttttatatgggcgattaccgttaatcggaagcgccttttttgtggaattgtcgcaataagcatagatctctttgggttgataagtaatattatcagaaacacacttcgggatttcatgtggaaatgcagatggaatatttgtttgagaaaaatgtgagaatttctttcagctgaatgtctgcatcggattccgtgtcgcttccacgtttggacaatccgacgggtgcatgtccggcacaccggagacaatgggcggactttctggtgtccctaatggcacctcttcacagacaatataaaaccgcgcgaaccgaactcgccggcatctgctattgaaaatagggcagatgccgcctcagacagcggcttcgcgcggttatgttttgttcgacataaagatggcatttatgccatctgttgtctggtgccgcaagggacacacacaaaagtcctacaaattgtcttccgggatgcggacatgacccgcggagtgctccaaacttggaaagacacggatcatcgaagatgcagacattcggctggttagaaattccatattttttgaaccgaatttccatctgcatttccatctgaaatcccacggtgtggtcttcttataatattacttatcaaagcaaacatgatatgcttattgggacagttccataaaaaaacaggccaaagcaccacggtgctttgcctgttttttagccacttctctattatacgttgatctccgcctttacgccgagttcgtcctgattcttctccaataccggatttacaacgtttgcaaggaatgcatccacctgtaccggtgcgcgtccgacatacttggacggctccatggttgcctgcagctgctctaacgtcagattgaactccggatctgccgcaatcagctccagcagattgttgtccttaccctcttccttgacattctttcctgcctgcatggacagctggcggatcttctcatgcagctcctgacggttgccgccgttcttcaccgcgtccatcataatattttccgttgccataaacggcagttctgccatcatatgctttgtgataaccttgtcatagaccaccagaccgtcgacaacatttaagcacagatccaggattccgtcgatcgccagaaatccttccggaatagaaagacgcttattggcagagtcgtccaatgtacgctcaaaccactgggttgcagaggtgatcgccggatttaacgcatcgatcatcacatagcgggaaagagacgcgatacgctctgaacgcatcgggttgcgcttgtacgccattgcggaggaaccgatctggttcttctcaaacggctcttccacttcttttaagtgctgcagcagacggatatcgttggacatcttgtgtgcacttgctgcaatgccggcaaggatatttgccactctggtatccacttttctggaatatgtctgtccggataccgcatagcactccttgaatcccatcttcgctgcgatcatcgggtcaatcttatcgatggtctcctgatccccgtcaaacagctccaaaaagcttgcctgcgtaccggtcgttcccttggatccaagcagctttaaggtgctcatcacatattccagatcctcgagatccatcaaaaactcctgtgtccagagtgtggcgcgcttgccaaccgttgtcggctgtgccggctggaaatgcgtaaatgcgagcgtcggcagattcttgtaagtatccgcaaactttgccagttccgcaatgacattgaccagcttcttgtgcaccagctttaacgcctcgttcatgataataatatccgtattgtcgcccacgtagcaggaagtcgctcccagatggatgatgcctgcggccttcgggcactgctgtccgaacgcgtatacatggctcatgacatcatgacgcaccagtttttcgcgctcttttgccacatcataattgatgtcgtacacatgctctttcatctcgtcaatctgttcctgcgtgatgaccggctttccgttctcggaaagtcccagctccatctctgtctgggcaagtgcaatccacagctttctccatgtggaaaacttcatatcctgtgaaaaaatatactgcatctctttgcttgcataccgctctgagagcggacttgaatatctgtctgtactcattttttctccttacctttatccataggcttgctgcattttctaaaattcaagatatcctgccacctgctgcatttccctttgctcccggcgcccctgccgcttgctgcattttcctcgaatctaaacttttctgctgcctgccacattcttctatattttcaagaagctttttacctctcgtagtctcccctgatatcttccttcggcggctccatcgggtaaataccgttaaaacatcccttgcagatcggcagtccgtctgccatctcactcagacggtcaattccgagataaccgagcgaatccgctccgatgatgtcccggatctcctcgatcgtgcggttgtacgcaatcagctgttcccgctccggaatgtccgtaccgaaatagcacggccataaaaacggcggtgaactgatgcggacatgcacctccgtcgctccggcatcccgcagcatttttacaatgcggtcggatgtggttccgcgcacaatcgagtcatcgatcatgataatgcgcttgccgtccaccgcctcttttaagacgttcagcttcacgcggacgctggactcacggctgctctgcttcggcttgataaacgtacgtcccacatagccgtttttgacaaaagcggttccgtacgggatgccggactgcagcgaataaccgagcgcagcggcattgccggactccggcacgcccaccacaagatctgcatccaccggcgaatccatcgccaggaaccgtcctgccttgatgcgggatgcatatacgctcacgccgtcgatatggctgtccggtcttgcaaaatatatgtactcgaaaatgcatctcgcttcctgctcctttggcagtgcgcgggacagatccgagacaattccattctccggcgtgatcgtcaccgtctctcccggcagcacgtcacgcacatactccgcgccgatcgtatcgagtgcgcaggtctccgatgcaaggatataggcattatcgcgctttccgatacaaagcggcttaaaaccatagggatcccttgctccgaccagctttctcgggctcatgaccacaagggaatacgctcccttgatcttgcgacaggcacgccccactgcttcctccaccgtactggatttcagacgctcccttgcgatatggtaggcaatcacctccgagtcaatagtggtctggaaaatagctcctgtatactccaaatcatgtctgagttccgccgcattgatcaggttaccgttgtgcgccagcgccagagttcccttgacatagttgagcaccaacggctgtgcgttttctctggtcgacgcaccggctgtcgaatagcgcacatgccccacgccgatatccccgtgcatgggctctaaattctcctcggtaaaaacctcattgaccagtcccattcccttgtaggaggtcactttccctttcggaccgttcgtctcgctgactgcaataccgcagctctcctgtccgcggtgctgcaatgcaaacagtccgtaatatattgtggatgccacatctccgccgtcaaaatcgtacattccgaagacgccgcactcctcatgcagttcatcccccaccggctgatttttattgattctattatcgctcattgatttccccatctacgaatctgatattctgtctttttatgcctgaaacggctttccggtaagaagctcaaatgcctccttgtacttggccacggtcttctctaccacctcctccggcagaagcagatcgttgtccggatttgcctttaaccagtctctgacaaactgcttgtcaaaggaaggctgaccttttccggcttcatatccctctaacggccagaatctggaactgtccggtgtcagcatctcgtcacccagaacaacgttgccgttctcatccagaccgaactcgaattttgtatctgcgataatgatgcccttgcttaatgcatactctgcacactttttgtagagagcaatcgtcttgtccttaatctgtgctgcgtaatccgcacctttgcccgggtagatcttctccagcactttcacgctttcctcaaaggagatgttctcatcatgcagaccgatctcagcctttgtgctcggtgtgtagatcggctccggcagcttgtcggactctaccagtccttccggcagtttaataccgcatacggtgccgttctcctgatagcttgcccagccgcttcctgtaatatatccgcgcacgatgcactcgatcggaagcatctcaagcttccggcacatcatgctgtttccctcaaaacgttcctgccggaaaaattccggcatatcctttacgtccacggaaatcatgtggttcggcacgatatctttggtgtaatcgaaccagaacttcgacatctgggtaagaattgcgcccttctttgtgatcttattctttaaaatatgatcaaaagctgagattctgtctgtggctacaataatcagactgtctccattatcatatacctcacgtacttttccctcttttaccggcttaaattcctgcatttcatcctcttttccgaagccttcccggcttcttttgttgatatttacagctttacccacttccgcagactatttctgcactgtacttcaaaattataatacagccgcttttggaaagtcaatgtttttacccgctcacaccatttctgcgatatagaaaatcgagttctttttattagtatttttgtacatattcattatttcattagcgtgacttataggcttgttcacacagcctaattcatattttgtcttaaaaaaaatacatgtttctcccttgacgtactttagtaccagagttataataactgcgtagataggacaaaagcactacttttgcaattatctaatttcatataactcctctttatctgccaccagggcagatgttccagaaaacggtccccccgttttctgaatcctaacacaagaaaagcagcccctcccccgggactgcttttctcgttctattctttattttctgaccagaagtgactttcctgtcatctctgccggctgctccattcccatcagttcgattaacgtcgggataatatctgccaggcatccgttctctctgagtgtgtaggacggatctgcattgaccagaataaacggtaccggattcgtcgtatgtgcggtaaacggtgcacctgtctcgtaatccaccatctgctctgcatttccgtggtctgcacagatgaacatctgtccgtctacttcctttaatgcctccactgcctttccaacgcaggtatctacggtctcgattgccttgatggctgctggaatgataccggtatgtccaaccatatccgggttagcaaagttgatgacaatgacatcatacttttcggaacggatagctgcacaaagcttctcacacacttccggtgcgctcatctccggctgcagatcgtaggtagccaccttcggagacttcacaaggatacggtcctcaccaacgttcggctcctcaacgccgccgttgaagaagaatgtgacgtgcgcatacttctctgtctcggcgattcttgcctgtgtcatgccgtgcgctgccagatactcgccaaatgtgttcttaagctccactttcttgaaagcaacttccttgttcgggatcgtcacatcatactcggtaaagcagatatatttcacattctttctcgcgcctctgtcaaatccgtcaaattcatcggcacagaaggttcttgtgatctcacgtgcgcgatccgggcggaagttgaagaagatcacggtatctttgtccttgatcgtcgctaccggcttgccgttctcggtaatcgcggtcggtacgaagaactcatccgtcacatcctttgcgtaggaagcttccattgcagcaacagcgctctctgcggtctctccctcgcccttggtcagcacatcatatgccttctgcacacgatcccagcggttatcacggtccatcgcataatagcgtccggaaatagaagcaatcttaccgatgcccagttctgccatctttgcttccagtgcctcgataaatcccttaccggaagtcggagccgtgtcacgtccgtccaggaagcagtgtacgtatacattctttacgccctgtctcttggcaagctcgagcagaccatacagatgtgtaatatggctgtgtacaccaccatccgaaagaagtccgtataaatgcagatcagaattgttctccttcacatttgcaataccgtcaagcagcgcctgattgctgaaaaattcgccgtcattgatctctttggtaatgcgtgtcagctcctggtatacaattctgcctgcgcccatatttaagtgtcctacctcggagttacccatctgtccgtccggaagacctactgccagtccgctggcatttccctttacaaatggatattccttcatcagtgcgtcgatattcggcttcttcgcctgtgcaacggcatttccttccgtcttatcgtttaatccgaatccatccaggatcatcagtactgttggttttttactcattgttcttccctctctctttattttcggttgccaacaatgtcgatggcatacccatcattatctgtcgtgccgcggatctttgtcttgcttgtatccgaatcgtacacgattacctgcgaaggataatcccccgctgttttatcataaacattaccgtccgcatccattccgatgtcatcggaaattgcagccaggtaatgataaaacccgtctttatcatcctgctctgtcagaatgcttgtaactagtcccttctgtatacacgggacataggaaagtgtcaccgcgccgtcctctgtgatcgtaatcttggcaagcgttgtatacagcgtcccggtggaaaaccagaaatttccgagactgtacgcaaccggcacaccatcggtaaaaccacatccctgcagccggtgcggatgtccgccgatcaccgcgtctgcgcctgcctccgcatatagctccgccagaagacgctgggatttttcttcgtgcagactgccttccgttccccagtgcacttccacaatcacataatcacttgtggcgtccgcttcccggatcacctccagaaatgcggcaggattcaaggtctttaatactcccggttccgtctccgtcgcctcttttgtatacttggtcgcccgctcaatctgtgtggcggaaacaatggcaatctttctgcctccgatcacaaaagagaggatcttggatgcctcttttcgattctcgcccgcccccgtataagggatgtccgctttccgcagacaatctaaggtcgacagcagtccttcttccccgtaatcatacacatgattgttggcaagcgtcacagcatccgttccaaaaacagagaggagttctacatcctccggatctgcccgaaaggtatatgccttcccgggaaccgcctccacgctcccgctctctgcgtaggtgaactcattgttcatcaccatcacatccacgttctgcatctccgagagcagatcctccgaaaagcagtcatagatgccattcgtctgccggttcatatactccatcgtataccagtcgtcggcaaaattgatgtcacccgcaaagccgagcacgatctttccatcctctccggcctctttccagtatacattttgcagccggtactgctgaaaaccactgtccctgcaatacatcaaccacagtacatggatggagctgccggtaatgtcataccagacttccggatcctccgttccatccagaacggcactcgcgatccgcactaccttctcatctccgtatctggcagccagccacatcaaaaacgaatcatcgactgcatatcctgcgataaatttcttcgtcgcaccttgtaatatcactgcaaatgcgtctgtcaggtccattctctgtgttgcgctctctgtcatctgcgtacgttttgtatctccggcattccaggtcttctgttgtgccggaatattctgtcctcctgcaaaaatatctcccagaagtacagccaccacggttactacaagtgcatttctttttcccttgcactttttgggcatacattttctccgctgtcactcaaaattctcttatattaccacttacaaattttcacgaaaacccgtctctctccgcctgttaccgcagagagaagcgggtccccgttccatgatcgtaccgctccgcagcgatcctgattccctgtaattttaaactattacttatagtttacaatctttccaaagtcagcctttaaggatgcgccgcctacaagaccgccatcgatatccggctgtgcgaacagttctgccgcatttcctgcattgacagatccgccgtactggatacgaaccttctcagctgtatcggtatcatatacctcagcgatgcagtcgcggattgccttgcagacttcctgtgcctgtgcggttgttgctgtcttgccggttccgattgcccagatcggctcatatgcgattaccatggaagcaacctgctctgcggtaatatcctttaagtccgatttgatctgaagacggatccagtcaagagtaacgcccatctctctctgctctaatgtctctccgcagcaaaggatcggggtcagattgtgctcgaatgctttcttaactttcttgttcagcatgcagtcgcactctttgaagtagtcacgtctctcggaatgaccgatgataacatacttcacgcctgcgtctaccagcatctccggagagatctctcctgtgtaggcacctttctcctcgtagtacatattctctgcaccgactgcaacgttagtacctttgactgcctctacaaccggtacgatatcgattgccggaacacagtatacaacttcaacatcatcacttactacaagcggctttaactcttctactaactttactgcctggcttggagtcatgttcatcttccagttgccggccacaattttctttcttgccattttaaaatcctctttcccttaagaatgatcccatttatgtatctgctgccacgacgttttgtaccgtcacgacagcaggattttgttatttatttgtcgtctgctgctacaacacccggaagttccttaccctctaagaactctaaggatgcgccgccacctgtggaaatatggctcatcttgtctgcaaaaccaagctggtttactgctgctgcggaatcgccgccgccgatgattgtggtagcgtctgtctcagccagtgcctttgctacagcgatcgtaccttttgcaagtgtcggattctcgaatacacccatcggtccgttccatacaacggtctttgctgtcttaacagcctctgcatataactcagccgtcttcggtccgatatcacagccctctctgtcagccggcatattcttaacgtcgcaaacctcaacctcaaccggagcgtcgatcgggttcgggaaatcagcgattgtcactgcgtctaccggaagtaacagcttcttgccaagcttctcagcctttgccatcatctccttgcagtagtcgatcttgctgtcgtccactaaggatttaccgatctcataaccctgtgcctttaagaaagtgtaagccataccgccaccgatgatcaaggtatcacacttctcaagcaggttggagataacgtttaacttgtctgcaacttttgcaccgccaaggattgcaacaaacggtcttaccggattctcaactgcattgccaaggaatgcaatctctttctccatcaggtagccgacaacgttggaaccgccctttgcgctgatgaactttgtcacgcctgctacggaagcatgtgctctgtgggaagaaccgaatgcgtcgcatacgtaatcatctgcaagatctgctaactctttgctgaactgctcgccgttcttggtctcttcctcgccgcggaaacgtgtattctgaagtaatacaacatctccctctttcatagcctctaccgccttggtagctgcctctccggttacgttgtaatcagatacaaatacaacttccttgccaagcttctcggaaagtctctttgcaaccggtgctaaggactcgccctcgtttggtccgttctttacttttccaagatgggagcagaggataaccttgccgccatcgttgatcagcttctggattgtcggaagtgcagccacgatacgggtctcatctgtgatctcgccattcttgagcggtacgttgaaatcgcatcttacgagcactctcttgccttttacattgatatcatctacggattttttgtttaatgacatatgccatgtccccctttaatatgcaaaatgtcaaaaagggacccggtccataaaagaccggacccctttctgagtctatcacgtgattgtccgagaacaatctctttctctcaattatgctaactcggagaagtatttgatggttcttaccatctgagatgtgtaggagttctcgttgtcataccatgaaacaacctgaacctcatactgatcatcagatacctgatttaccatggtctgagttgcatcgaataaggaaccaaatctcataccaacgatatcagaagatacgatctcatcctcgttgtaaccgaaggactcgtttgctgctgccttcatagctgcgttgatgtcttcctttgtaacgccggctttcttaacaactgctgttaagattgtggtagaacctgtcggggtcggtacacgctgtgcagaaccgatcagtttgccgtttaactccggaataacaagaccgattgcctttgcagcacctgtgctgttcggaacgatgttgactgctgctgcacgggatcttcttaagtcaccctttctctgcggtccgtcaagagtcatctgatctcctgtataagcatggatggttaccatgataccggactggatcggagcgtatttgttaagagcgtctgccatcggtgccaagcagtttgttgtacaggaagctgcggaaatgatggtatcagaagcctttaatgtcttgtggttggtgttgtatacgatagtaggaaggtcatttcctgctggagcagagataacaacttttctagcgcctgcgttgatatgagcctgagccttctccttggatgtgtagaaaccggagcactctaatacaacgtctacttttaactctccccatgggcagttatttgcatccgggaatgcgtagatcttgatctccttgccgcatacgatgatggaatcgtctgtagaagatacctcatctgcatgctcgtacttaccctgagatgagtcatactttaacaggtgtgctaacatcttcgggcttgtcagatcgttgattgctactacttcatatccttctgctccaaacatctgtctgaaagcaagacgaccgatacggccaaaaccattgattgctactcttactgccatttttaattcctcctagaatttgtaaatgtaatcgccgggcataaatcccctggaaccggcaagcacaaggtacttatgcttattggctccgtgcttcctatattctaaccaatttccatagaaagttcaagcctttttctccactttattgccactttgttaaatttttcactatatcacaggttttttttcccttttccggaaaaatatacaaaatctgaaaatacgccggaaaatctgctgacgctgcacgcccgctgtgttatacttttttctggtaacctgtaaacataccaaagaggagttttcttatgtcagaccttatttttttactgattttgtttgtttttgttcttatattatccgcgacgccgctgtttcgcaaaagccgcagccagcgggattatgagagttccggcatgcagctgcttgccacttcccgcggcagggtcctgctgctccctgccctgggctgtctctgcgcgtgtatcgtcacattttttatggtgcttatgtatcaggacatcggttttgaggcatcggatataggctctctgctctcatgcatcggcatcaccatcctgttagttgtcgtctgctttctcggcggttacgccatgcaggcacgtcatgttctatataatgaagaaatccttctgatcgggaaaccgttccgcccctaccagaccattcactggtatgaaatctctgagatgcggatcaaaaatcaggacttttttgatctgtatgacagaaacggccgccgctgcgtcagcgcaaatgcgaatctggaaggctaccggcaattttatcaggcatcgttacggttcacccgtcccgaatacaccgcaaagcaaaaaagcaccccgtacgacaatccggtgtctgcggcatccggctgcggaacactgcgctaccggaccggcgaatattacgcgctcctcatcctctatgcggttgtcatgtttctgtttttcggcttgaccgttttttccggggaaagcatttcgggaacgctgcagatcatccgcgaagaaaagctctacggcgcccttttctttccggtcgcgtttgtcggcaccgttctggcactgttttatgtcagtctgcagaaaatcacctacgaccgcgaaaaaattgttatttcccgtttcccccgccggacacaaaccctgctgcgccgggatatccgccagcttgaatgtacctccggcagtcaggggctccggacgcttaccctgcacacagataaccgcagatatgtgatccgcgagaaacagttccgcgtagggttcccggaatttttcaacgaactgatccattaaactcacacagaaaggaagatctctatgttatgggatacacatatgcacagccaatattccggtgacagcgacgccccgcaggaggacatgatccgcgctgcaatcagggcaaagctccccggcatctgttttacggatcatctggacatcgactatccggacaacccggaagcgttcctgttagacctgccgaactacacgtcatccgttttcgccatgcaggaacagtaccgggatcagatcagcgtgcgctacggcatcgagctggggctccagccgcatctggcagcgctgcatgccgatattctctcgcagtatgacttcgactttgtcatcggttcctcccatgtggtacacggctatgatccgtattttccgccattctggaagacgcacaccgaggaggaaggataccgcgaatactttgagtccatcctggaaaacatccgggcatttgatgactttgacgtctacggtcacatcgactatgtcgtgcgctacggtccgacgcgcaacgagaattatacctacgccagatacagcgacgtgatcgacgagattctaagacttctgattgaaaaagggaaaggcatcgagatcaataccggcggcttcaaatacggactgggacatccgaacccctgcgaggagatcctcgcgcgctaccgtgagcttggcggtgagatcatcacggtcggcgcggacgcccatgccccggaacatgtcggctttgcctttgagaaagtgcctcagattttaaaggacgccggttttatttactacacggtcttccggaaacgcaagccggaattcataaaaattgaggactgaccgccgcatccggcgctccagtcctcattctcactgacattttatacgttgatgtcctgtttttatttacgcatctcttctgcggcgcgctctatgtaaaaatcaagcagttcatagatccagtctttcagattggaaaacacaaatcccgtacgcccggcgcgctctgtattgatgctgtagccgggcgtcccattatatggcgccggatcgccggtctcatcaagaaacgcctcttttccggtgcgtctgtacacgtaagtcaggatctcccgcggcgagatggtcccgcggctcgctccgttgacggcaccctggatctcatccccgccgagatgcgccagaaggcgccccgcatcgtccacgctgataaagctcatctgtgcgtccatattatcaatatacatcggtttctgccgcaccacatgttccacataaaagtacagccggtccgtgtagtcatccctgccgatgacgtaggggaatctcacaaaagccgcatttttcatcggatactgctgcacgagcgcacattccgcacttttcttcaatacgtcatacgatccgctgtaatccgtataccagaccagtctgtcatgttccggctcatagtccgtctccacggtctgaaaatgcagatcatacacggatgccgaggacaccatcacataccttctgcagggcaccgcctccagcacggtgcgcacatcccccgcacagtaagccagatcgtcgtagaaaacgtcataatatttatgggcaaacacctgctccatctgccggacatccgtccggtcgacgatcagacgtctgactctgtctccaaaatcatccggcgtccggccgcgtgttgcgatcgtcacctcatgtccccggtgcaaaagttcccacaccagatgttttccgaaaaatcccgttccgcccagcactaaaatattcatacgtttctccatctttcttcttcccgttttccgttccctttcgcactattatactcattttgcgttgttttatcaacaatcccccaagaaccgaacggcaaaagaccccgcagaaaggtttttctcctcgctgcagggtctcttttacttcccgttattttttcttttacttaaaatattccacgccggactcaaacagtctcaaatcctgctcaccgtaaatattcatcgccacactccggtcacgacgctccgaatgtgccatcttgccgagcactcttccgtccgggcttgtgattccctcgattgccatgtaggagccgttgacattccactcctcatccatggtcggaacacccgcctcgttgacatactgtgttgccacctgaccgtttgcaaacagcttctccagccattccttcggagcgacaaaacgtccctcgccgtgggaagccggattgcaatatacctcgccggtctttgcctgtgccagccacggggacttgttcgtcacaaccttcgtgtataccatcttgctgatatgacggccgatcgtgttgtaggttaatgtcggtgaatctgcggtctgcggacggatctctccgtacggtaccagccccagcttaatcagtgcctggaaaccgttgcagataccgagcgccagtccgtcgcgctcgttcaaaagcttcatgaccgcctctgtcatcttcgcattgcggaacgcggtcgcaaagaacttcgcggagccctccggctcatctcccgcggagaatccgcccgggaacatgataatctgtgcctgatcgatcgcctttgtgaactcctcaaccgaatcgcggatgtcctctgcattcaggttcttgaatacctttacgatcgtgtccgcacctgcgcgctcaaatgctctcgcactgtcgtactcgcagttcgttcccggaaataccggtataaacacggtcggttttgccaccttgtgtttgcagacatagatactgtctgcctgatagatgccggtgtcaagttcgtccttattatctgtcacgcgggtcgggaatactttctccagcgtgccgctccatgctgcgatcgcctcgtcgagtgcaagcttcatgccgccgtagcagaagctctgttcctcatttacccagccgacaagctcctcatttccggaaagtcccgctgcctttaatgtctccttgacaataccaaccttctccactggaacctccgccacgatattaccaaatcccggtgcaaacagtgtctcttccgacacttccttctcaatcgtcacaccaagcttattgccaaatgccatcttgctgactgccgccgcaagtccttttccatccagcgcataggcggatacgaccgcaccctttccgatcagctcatgcagcaccgcatagagcttcattacctgcgcatagaccggaagatcataagaatccctctcgatggagaaaagtaccagctgatttcccactgccttaagctccggcgtgatgatgtcgccctcttttgccacatccacggcaaaggataccagtgtcggcggtacgtcgatctcgttgaagcttccggacatggaatcctttcctccgatggacggcagtccgaagccgatctgtgcattgtacgcgccaagcagagcagcaaacggctgactccagcgcttcggctcctcgctcatcctgcggaaatactcctggaaggtaaagcgcaccttgctgtaatcgccgcctgcagacacgattctcgacagagactcaagcactgcatacaccgcaccgtgatacgggctccaggaagacagatacggatcgaagccgtatgccatcatcgtgactgcatcggatttgccggtcatcaccggaatctttgccaccatggactgtgtctcggtcagctgatatttcccaccgaacggcatgtatacgcttcccgctccgatggaaccgtcgaacatctccaccagtcccttctgagaacacacattcaagtcggcaagttctgcgagccatgctttcttcatatcgcctgctgctaacgcctcggaaaccgccggtgtatcgatcttattcagataattttccttcgggtccggcatatccactgccacattggtctcctgatgtgcaccgttggtatccaggaatgcacgggataagtttacgacttcctttcctctccacgtgagtaccagtctcggctcctcggtcacaaccgcaacctcgacagcttccagattctcctccttcgcaaatgcaaggaacttctgtacatcctccggtgccactacgaccgccatacgttcctgggactctgagattgcaagttcggttccatcaagtcccgcatatttcttcggcaccttatccagctgcacgcgcagtccgtctgccagctctccgatggcaaccgatacaccgcctgcaccgaagtcattacacttcttgatgatatgcgccacttcctcgcggcggaataatctctggatcttgcgctctgtcggcgggttacccttctgcacctctgcaccgcagactgcggtggactctgtgttatgtgccttggaagaacctgtcgcaccaccgatgccgtcacgaccggtacggccgccaagcagaatgatgatgtctcccggatcggaggtcagtctctgcaccgcacgtctcggagccgcaccgagcactgcaccgatctccatacgcttcgccacataattcggatggtatacctccttgacataaccggttgccagaccgatctggttaccataagaactgtaaccgtgtgccgcctcgcgcacaagcttcttctgcggaagcttgcccgggatcgtgtctttcacggaaactgtcggatctgccgcaccggtcacacgcattgcctgatagacataggtacgtccggaaagcggatcacggatcgcaccgcccagacaggtcgcagcaccaccgaacggttcaatctctgtcgggtggttatgtgtctcgttcttaaagtttacaagccactcctcagtcactccgtccacctcgatcggaacgacaatcgagcaggcattgatctcatcggattcctcctgatccatcagcttgccctcctttttgaggcgcttcatcgccattaaggcaatgtccatcaggcacacgaatttgtctgaacgtcctgcgtaaagattcttatgggtggcgaggtaatcctgataggtctcctccatcggcgcacggtaatagccgtcgtcaaagcttacgtccttaagttctgtggaaaacgtcgtatgacggcagtgatcggaccagtaggtgtccaatacgcggatctccgtcatggacgggtcgcgcttctcctcattcttaaaataattctgaatatgtaaaaagtccttgaaagtcatcgccagaccgagggaatcataaagttccttcagttctgcctcaggcatcgcagaaaatccgtcgaaaatctttacatcctctggctccgggaacgactgcaccagcgtctgcggcttctcaagaccggtctctctggagtcaaccgggttgatgcagtgctttttgatcgcctcaaactctgcatcgctgatctctccctcgatcacataggtcacagccgtgcggatcagcggctcctcgttctcatttaacagcttcacgcactgctcggcggagtccgctctctggtcaaactgtcccggcaggaattctacggaaaaagttctcgcgccatttaactcaaaagtttcctcgtacacatcgtccaccggcggctcggaaaaaacggtaaccagagccttgcggtaggtttcctccgatacatgctccatatcgtaacggatcagctcacgcactcccttcacgtcactgataccgagataatttctgatctctgcttccagctctcttgctctgacagcaaatgccggttttttctccacatatacgcgtcttacgttgctcatattttccctccatctgcgcacgccatcggcgaaactactgatcgtttgtatttctatcttatcctactttctatatgaagtatagcatatgcgaacaaataagcataattaatatatttaatctcttctattattatggttaatatatcacataagatttatttgacagttttataagcaggtcttataattatagttaacacgctacagaacggttcggagcagcgctccgacagaaacgaggaaccatggatatcaattacgaattgtataaagttttctattatgttgcaacctccctcagcttttccgaggcgagcaagcagctctatatctcccaatccgccgtcagccagtcaatcaagacgctggagaaaaagctggagcagccgctttttatccggagtaccaaaaaagtacagctgactccggcaggaaagattctgctcaagcatattgaacctgccatgaatttaatccggcgcggtgagagccagctgttagattccggcagcctcggtctggggcagcttcacatcggcgcgagcgacaccatctgccgctattttctcgtgccgtatttaaagcagttccacaagaagttcccgaatgtcccgatcaaagtgacaaactcaacctctctcagctgcgtagagctgttggagcagggaaaagtcgatctgattgtgaccaattttcccaactctaatttaaaccagtcctacatccgcaagactgtgtgcagctttcacgacgtctttatcgccaaccctgcctattttaatctgaagcagcaggagattgccttagaggatctgcagcagtacccgatcctgatgctcgaccgcaagagcaccaccagcgaatttttgcataacctctttctgcagcaccagcttgaactgatgccgcagatcgagctgagcagcaacgatcttctgattgatctggcacgtatcggcctgggaatcgcgtttattccggactactgcctaaaccgcgagtccagagagctctttatcgtgaagatcagggaaaagctcccggcgcgccagatggtcgccgcagtcaacccgacgcttccaatcgcgcagtctacggaagaattcttaaagctcctgccgtctctcccagaactcggctaacatctgttctacttcatttacgttacatatccggcgctgttcccattcccttgggaacagccctctgtaatcactctttaaaaaccgctcgtccagcagttcaatcactcccacatcctctgtcgtccgtatcacgcgtccggccgcctgcaataccttgttcattcccggaaagcggtacgcataatcaaagcctgcccccgctctctcatcataataatgcattaaaatctcgcgttcattgctgatctgcggcagtccggttcccacgatcaccgccccgatgagctgttcttttttcagatcaatcccctctccgaaaatacctccgagcacacagaatgccaccagtgaaccgcctcgccgtttcgatgtctcaccggaaaatgcctgtaagaaagcctcgcgctccgcctcacgcatcccggtctgctgcatcatgcaccagagacgcggctctgcatttccggaattttccgcatcattgggatgctccgcaatttctgcctcttcgggatgctccgcaatctctgcctcttcgggatgctccacaatctttgcattctctgctccttccggaaaatactcctgcggacgcatttcatccgtctccccgccctctaaaaacacatcgtagacttcctgcatcatccggtaggacggaaagaacaccatatagtttccctgcttcgcgcgcgctgttttttctatatataatgcaatccgctcatactctgccctgccgcgcctcgtgtacttgctgctgacgtcatttccaaacagcagcaggcgctgttcctcggaaaacgccgtctgcgcgtagaccgcataattatccctgcgggtggacagcaagcttttataatactggatcggaagcagtgtcgccgagaaaaagatcgtcgcatttcccttgtctatgcgctcctgcagattgagggagggatccacacagtaaaacttcagcttgaagcgcccgtcctcctcatgctcggaatacacgacataatgctcgtccaccagttcgtagatattcatgaaattgcgcaggtttaagtaaaattcgttcacttccctgcgttccgggaaatcgggacttttctgcagatactcatcgagatctgccgcaaggcgcgtcagtgcaaagatcagcgtaccgatattttcatatacgacatagttttcgcactcacgcttgtacccaaggagaattcggttgcatttttccagatgccggatcacacgttccgcacgtctgtcatgcttttcctgatagggtttcagcagctttttgaccgccaagaaatcttccttatagatcgccgcgctgtacatttcccggctccgctccacaagattgtgcgcctcatccaccagaaaaatgtagtccccgcgcgttccttccgcaaaaaaacgcttcagataaacattcgggtcaaagacataattataatcccctatgatatcatccgcccaggttgccgtatccagcgacatctcaaacggacagacccggtactcccgcgcctgctctaagatcacttccctggtaaaaacatcctccttctgcaacagattgtacaccgcatcgttcacgcggtcgtagtgtcctttcgcgtagggacagtgtacaggattgcagtccatctcctcgcacaggcacagcttttccttcgccgtcagctggatgatcttcgcctgataccccctggtgcgcaaaagttcaaatgcttcctttgccaccgtgcccgtgatcgtcttcgccgtcagataaaaaatcttgtccccgagtccctcgccgaccgccttcaccgccggaaagaccgtcgaaatggtcttcccgacgcctgtgggtgcctggataaacagattcttccggcgcgcaatcgtgcggtatacgtccgacgccagttctttctgtcctttccggtatgcatagggaaactccagctttttgatggaagcctgccgcagattctgccaggcgaactgaaaatccgcccactttttatattcgtccgtcagccgggtgaaccactccgccagctccgcaaacgaaaatgtttccctaaaatatttcagattccccagaaacgccgtctttgtcagttcgattgtatccagattgcagtaggtcagctgcacggagatctctgcaagatcatgctgcaaggcatagatataggcataacacatcgcctgcgcgcgatgcacgcccacgggttcatccagcgcatccagattcatgtagatccccttgatctcatcaatcgtcacatgcatgtcttcctccaccgtaagatggttgaagttattcgaaaaatcaagctgtctctccccgtcgcacgtaatctcgattccgtccgcccgtccctcgatggcaagcgtgtaatctccctcgctaagttcgatcttaagcggcacctccgcatggtaattcgcgcctttgctcttctgaatgcgcttatggatacggctgccctcccacatggcctccggggacgcagttctcccgtggcggttatcaatgtctccctcccgcagaatgaactccaccagattccgcaccgagatctttatgattttcttttcgtctttttcctgttgtgcatccatacggcagcgctccctactttccagtttcttatcatacagtgtaacacaaaaacagggctgctgcacgaagaggtttctctccggcagcagccctgtctccgtctgtctgactagcagactgcatatttctgtaccgtattctcaaacccggtgttctgtccgccgtattttacggtcagatccttgctgagtccaagatacagcattccgagcagtgattttgcatcaatcacagctctgttataacaaacatcgatatcaaaatcacattttccggcagctctcacaaactcctttacttcctccgtgtcagacaatctgatttttctctctatcatattattcatcctttcctactataaaccaaacgtgtttctctgatttccgcgcaattattgcataaatttttttctttgtcaaatttgacgcaaccggtaaaccacttgaaagtacgggcaatctgctcatttctgtgcccgatttttgccgttttttgcaatctctttttgcgattttctctcaaaaagcaaactgcataattattcttgtgcacactttctcatttcccgcaaaggtacgtttcgtttttgtaatattttcacatattttttccccagagaaaactatttttcatctctcagtttcctaagattctgcttgagcgcctccacggcgcggtcgatctcttcccttgtcgtctctcccgacaacgtcatacgcacggtccccggtgcgtattcgtccggcacgcccaacgccccgattacataggagacccgctcctccccggtgttgcaggcggagccgcccgaggcgcagattccgtcctcatacagcagaatgagaagtgatgcaccgtccacgccggaaaagctcacattcacattccccggcaggcggttcgtgggatgtccgttcaggcggacccccttgatctcatgcatgatcttttcaatcagataattgcgcagcatcatctccctgcggattcttctgcgcatattgcagaatgccagttccaccgctttccccatcccgacgatccccggcacattctccgttcccgcgcgttttccacgctcctggctaccgccgtggataaaggaaggcatcgtaaccctgtctcttacatacaaaaatcccacgcctttcggtccgtgaaatttgtgggcgctcgcactcagcagatcgatgtgatactgctgcatcgagatcgggatctgggcatacgcctgcaccgcatccgtatgaaacagaatctgatggtctcttgcaaaccttccgatctgcatgaccggttcgatcgttccgacctcattgtttccaaacatgaccgagatcaggatcgtatcctcccggacggcatgctctaactgttccagcgagatcattccgttttgatcgacgtccagataagtcacctcgtagccctgctcctcgagataatggcaggagtttaggaccgcgtgatgttcaatcctgctggtaatgatatgacgaccgtattttccatacgcttccgccacccccttaactgcccagttatccgcctccgatccgcccgatgtaaaatagatttccgacggtctggcatccagtgatgctgcaatcacctctctcgcatgggcaatcgccgcctgcgcttcctccccgtaaccgtaagccgttgacgcattgccaaacttttccaccagataaggctgcatagcggcttcggcctcctccgccatccgcgtcgttgcagcattatccagatagaccacacctgctttatattcctgatcgcacatttttcccccacaccttacatataataaaaagattccaattcccggagacacacttgccagacattcattttcccaggaattccgtttctggaaattctctgaaaaattccctgatcaccggcacactgctgctcacactcgccggtgtgctcacacggattatcggcttcttctatagaatattcctctcaaggctgattggtgcagaaggtcttgggatctaccagctgctgtccccggtgatggcgctcggtttcgccgtcaccgccgccggaattcagactgcgatctcacgcttcgtctcctccgagcttgcgcagaacaatcccgcgggtgcgaggctctattttcggatcggcctgctgctgtcgctgtttttatctgccgcgaccggctttgtaatctggaaatacgcagactttatcggtgtttccatgctcggggatgtgcggtgcatcccgctccttaagatcatctccctctcctttgtcccttgctgtatccacgcctgcatcaacggctgctactatggacagaaaaagacgggcgtccccgctctcacacagctcacagagcagatcgcccgcgtcggcacggtctggctgctctatcagatccatatgcgggagcagaccgccgttccgctctccgtcacaatgtggggcgctgtgatgggcgaagtggcaagcacgctcgtctccgtcagcgtcgcaaaacttccgaagggaacggacacggcgctttccgtgaaatgcggcacgcgcaatctccttgccatggcggttccgctcacggcaaaccgggttgttttaacgctcttttccagttttgaaaacatcatgattcccagccgcctgcgcctgttcggttacacggcttccgaggcgcttggcgtctacggcatcttaaccggcatggcgatgtccgtcatcatgtttccgtccgtcatcaccaactccatttcggtacttcttatgcccgccatctcagaagccaaagccggcggaaacgatgcgctcatacggcgcgcggtcttaaaaaccatccgggtctgtcttctgtggggctttttttgtacagcgggttttcttgctaccggtcactttatcgggaatgtgctttttgggaacgcgctcgccggaacatttatacggacgctcggctggatctgtcctttcctgtacctcggcgtgacgctgagcagtattctgcacgggctcggctacccgggcatcactttcgtgctgaatctgattgcctgcggcatccgcatcctctttgtgctgtttgccctccccgtctacggtatccgcggctatctgtgtggacttctcatcagtcaggccgtcatggctctcctctccatcggaattctgctgcgccagacacatcccacttcccgctctgcatccgcaaaataatatgcacaaaaaataccggcaagccagattacggtttaccggtatttttattctcattaaaagtgctaaatctgatctcaaattatactctggacagatactcacctgtacgtgtgtcgatcttgatcacatcgccctgctctacgaacagaggtacatatacggtagctcctgtctcgacgattgccggcttggttgcaccagtagcggtatcacccttgaagcccggctcagtctcagtgatctgaagctctacgaacagaggcggctctactgcgaatacgcttccgttgtgagagcacatcttcaccatctcgttctccttcacgaacttcagcgcatcgccgatgtcatctttggagagtgcgatctgctcataagtctctgcatccataaagttgtataagtcaccatctgcatacagataagtgtaatcttttctgtcaatgcgggcagtcggacatttctctgtaggacggaatgtcttctcaaccacaccaccactcttaatattctttaacttagttcttacaaatgctgcaccttttcctggtttcacatgctggaattcgataatctgatagatattaccctctaactcaatggtaataccatttctgaaatcgcctgctgaaatcatgtaaatttcctccttaaaaatacgctcgagttttactctctgatttttctattttataataaacagcgctatatttcaagctttttttcatataccgcactgcgccatgcgaatttgcacgctttttgctctgttcctggcgcaatctccccggtattattaagcgttgcgcttctcaatctcatggatcatatcgattctggtctggtgtcttccgccctggaattctgcatccagatatgccttgacgatgtctttcgcaagctctgtgccgacgattctggcaccgaatgcaataatgttggcattgttgtgttcttttaccagccgcgcagttgctgtgtcggagcacactgctgcacgcacaccgttgactttattggctgcgatggagattcccacaccggttccgcagatcagtacgccgcagtcagcctcgcctgccacaactgccctgccgactttctctccgtattccggataattgcagctgtccgttccgtcggttccaaagttgataacctcatgtcccagttcctttaaatagtccataatgacaaattttaactctgttgccgcgtgatcatttccgattgctattttcattttttcctccatcccgggttttggcacccgtccttttcattgtcacatgctgccactgttttctgcagcacaaactgcttcttttatcgcttctgcgctgcgctctgctgcttttggcattttctccgatagaaaaagaggacgatcttttccagatagcgctttaagacaatctggatctcctccttcggatggatcggctttaccagaatcgtgcggattcccgtgcggttggcgccatagacatccgtaaaaatctgatctcccacaaacaatgtgtttttctcatccgttcccatctgttccatcgcttttctgtaattcgccggattcggctttcctgccttgtagatataagaaacctgcaccgcgtcattgaacattttcacgcgcggttccttattgttcgacagcagcatgcaatgatatcccagctccttcaaatgtgcaaaaagcgcgcacgcccgctcgtccgccggcgctccgtgcggcaccagcgtattatcaatatcaaaaataacgcctcgatatccatcctcataaaggtggtcaaaatcgatctcataggtagaatctacgtattctcccgggtaaaaccgttccagcattgcccttttgctcctttactcatctcacttagtgcgcatccttacatagattactacatttctaccaaaatatccacccggaatttccaattcgcgttgttcgtttttctcagagcattatttacctcaccgcgaggtgcgcatccccgcagagcgtttttgtgtaataggaacgaagtttcctattacacaaaaaagactgcatacacatgtgtatacagtcctcatccgctcatgattctatagtataaaattctcatccggtctgaccggctgtacctcgtcaggattcgttcctacaaaaaactgatactgctcgagtacctgatccttacgcatatccgaaatggcgcgctcaacatccagtctggcaatgtcgctgtccacgcccttcagctcgtagaccgcatccggctggtagctgtttgcgtaatcgatggctccctgatccggtccgctcttcctgatggctgcaggcgcagtatactcctctgtggacggcgcctgccctgttacgctctgcggaagttctgccggcagttccgatcccacggtaacagtttgattctctatggagttgtaatcataaaatcccgcactgatgcggattcctgacaaattcattagaaactctccattgtaaccagaaaaaaatattactataactttttattatatcgacaaataaaaacagaaactttaccttcttttcttatttgtcgagcatttttttcagctcgctcataaacgtgttgacgtccttgaactcacggtacaccgacgcgaaacggacataggcaaccgcctcaagatccttaagcttatccatcacaagctcgccgatcagggaactcggaatctccttttcctcgcggttaaagatctccgtctccacttcatccacaagctggttaatctgattgaccgagattggccgcttatggcaggcgcgcagcacaccaccctcgatcttggaacggtcatactgctctctggtgttgtctttcttaatcacaatcagcggaatggtctccactttctcataggtggtaaagcgctttccgcaatcatcgcaaagtctgcggcggcggatggaattgttgtcatctgccggtctggaatcgatcactcgtgtattttcactgctgcaaaatggacacttcatttgctacctccatgggcaattttgcctatatattgtagtatatctatacatttgttgcttgtcaatgaaatttacacgattatatgaccagttttttatgtattttcacgaaattgtaattttttgtacaaactttctgttttattgtcccctacgcctattttaccttatgttttgcctctttctcatcaatgtccacaagaataatgtccggtccgatttttacaatcctgcaccacggaataaacacttcaaactcccttcccatgcagcccatccactttgccggtcccggcacaatcagcgccttgatgcatccgtcgcactcgtcaaaatccagatcccgcacatttcccaggcacttacagtcatttacgttgatgacctctttcctcgccaaatcgcaaaaacgcatatactcccccgtttgcttcctcggataagtatatgcgtcttttttcataatcatgtttgtctgaaattatacattaaagcggaacaggatcacatctccgtccttcaccacataatccttgccttccattccaacaatgcctttttcacgcgctgcagcgagacttccgttgtccagaagatcctggtagttgacaacctccgccttgataaagcctctctcaaagtccgtatgaatcttgccggctgcctgcggtgccttggttcccttcttgattgtccatgcacggcactcgtcctcgcctgccgtcaaaaagctgatcagaccgagaatactgtagcttgcagccaccagcttgtccagtccgctggattccacgccgagatcgtctaagtattccttcttctcttcctccgaaagttctgccagttcctgctcgatctgcgcacagatgacgaatacctttgcgccctcttctgttgccatctctcttacttttgcgacatgtgggtttgatgcgccgtcatctgcgaggtcatcttcggcgacattcgctgcatagatcgtaggctttgccgtcaaaagattgtatcccttgaaccagatctgtgcatcctcgtcatccggcacctcaaaggatcttgccatcttgccgtcctcaagatgtgccttgaccgcctctacaagttcgagttcctttgcaagagtcttatccattctcgcctgctttgcaatctttgcgattcttctgtcaaggatctcaatatcagaaaagatcagctccaaattgatggtctcaatatctcttgccggatcgatcgatccgtctacatggatgatgttggtatcttcaaaacagcgcaccacatgaacgatcgcgtctacctctcggatatttgcaaggaactggttgccaagtccctcgcccttgcttgctcccttcacaagacctgcgatatccacaaattcgatcgttgcaggtgttaccttcttggtatgataaagctcaccgagctttacgattctctcatccggcacagaaacgataccgatattcggatcgatggttgcaaatggatagtttgcagacagcgctcctgctttggtcagtgaattaaataatgtagactttccgacatttggaagtccgacgatgcctagtttcatatatatctatctcctttatttcctttttacgggctttttgctgtataccgctttgaccgctgcgccgttctcccaaaatccgtcctgtgcttcggcgggccaacgctcctcgcagctgtcttatggcgctattctaagagccccaaattagcacgattattatacactaacaggggctcgtttgcaatgttatttcatttttcagaacgctcaggcgtatccatggaagagattcttggcataggaaccgcgcttgctccaacccagaaccggaaatatttctcactttctctttgtaaaatattatactgtatcttacaatccccggatgatgttcaaataatccggtctatggtctacgacagcataaataatagcttcctgcttctcctcatttatcttgtaaaacacaagatttttctcaagtaccagtactttatacccctgtcttttaagcaccagataacgaagttctacacatttttgcggatacttgcctaagtcaagaagattccgttctaattcttcaagtttttcaagtgcaacttcccttccaaagttttctgctacatacaaaataatctttcggatctgagcatctgcagtttctgtctggacaactttataattcaatattctatccctcccgcagcatctgcctcaaatcctcaaaggtctcaccgagtggcgctactcttgcgttcctcacatcatcttcttccgtattgtctccataaaatcacctttctcgaatacatcgaatatacctcacctgaaatccatctgatacgatgaccttcagatacaaagaaagaccgctcactttcaatttttcttgaaaatgaacggtctttcatgcctctgttatttagttgaatgatgatgatattattttctctttgatacgtttccgaagccgcagtccaatacgactgagacattcacaccatctgaaattacttttttgtatgtttttcggtcactctggtcaaacctgaaaaacctctcaaagtgtcggaagtcgagaagttttacaaatctgtccgatgtagtacaactatcgtctccacatgaaaggactgctgtctatgaattaccatcgtgaaaagaaacatatccatgaaccttttaacaataggtcgaggctatcgttaaaaagtgtcaccactgaaaacaattttttaactgttctctacttttgaattgcttctataatatatgtctttccttggaaaggaacctcatctccaatccagcagcaagcaatttttgtttctgtgcaagcagctctgtatttcctggatcaagttttaataacttgtccacgtccttcaactgctgctgtgtactttttatctgaccgtttacgcactttaatgttgcttgtagtttggcggtatctccgccgatctcgacagtaatacccataattctgttagccacggccgatacctccttccgtaaaaatgggcataaaaaagcacagatttctccattcacgaaaaaagcaccaaccatttctgattgatgctttcaaattattttgtttttgtaaatctgtttaattgcgtatccacatctcgtccaccgtacataacacggataatcgtaaccacttgtgtatcatcatccggaatatatagaataagataattgtctactggcgctacgcgtagccctcgacttttccatggttccaattcatattgtcgatatctcttcggcatatgatcaagatccataatacatgcttcaagcctatcaagctgaccacttgcattttctggtgcctgcagttcaaaagcaatgtattccaagattccacgaaggtctatctcggcctgatctgaaatcacgatatcataaatcataaattgtaatccttgcggagatcagcaaaaacagattttgctgatctagtgcgaccagcctgcatatccgcatatcctttctctagttctgcattcatctgtgcttctgataatgcactaacgtctacaggacgagcggatggcattttcacttcaaaaggaagtcctctttgaagaataatttgtttgtaaaacatatttattgcattggatgcaggaattcctaatgctgctaagattccttctgcctgttcttttacatcaggctcaatgcgtgcgtatacatttgctgatttcgttgccatagtaaacactcctttcgagtttttctaactatattatatctatttgtacggacaaaagcaatacaaaatcaatattttacaaattgtttatactccaaaatctaccagttgattaaaatttgtcgaagtcctcctgagtcgccacttccttatatcctttataatcatcgtcactgttttcagcatacatatcattcacgaggccaatggtaagcaaatccaggtctcggatactaatccccagttgtacgcaacgaagcaaaaataaaggtgttgtcatcgggcgatctgttggacgaacttttacggattggaatgtgagggaaattctcgtgtattgtgttaagcacatccctatatcctgcaatctcacgctcatttcttgtctttggcattgtcttatccaaaacattctttttcaaacattcatcagaagtatagataccctcaattttattagaactctctgtactttgaatcttagccacctcaacaagactttctaatacatccgcatggtgttccgcaattaagcgctgttcccccttgtattcatgaattgttgtaaggtaacgcacgatttctggcgtaagcatttttttccattttttcgtgtaatcaaattgtctcattctaattacctcattttgaactcaacttcgtcatttcattcattatgacgcaagtcgccgccacccttaaaaagggtggctcgagacgctgggtgtaaccccttggtacccgacagcgtctcaaggcgccctagactttctcttcgttcaagtcactattgcacttgacgcgttgcttatgcccatgaatgggcgtttgtactacttcgacttaacccttaaaagggtcttcgtactccttcacacttaatttatcttgcatgatatcgtacttttcttgatcttgaatgtatttttttattgtcgcttcatttaatcctacggtgctgacataatatccctctgaccaaaaatgtctgtttccaaatttatatttgagatttgcatgtctgtcaaaaatcataagcgatgactttccctttaaatatcccataaaactcgacacactcatctttggcggaatacttactagcatatgaatatggtcaggcatgagatgcccttcaataatctccacgcccttatatgcacataactgtttcagaatatcacgtatatcctcttttaattgattataaataatttttcgtctatacttaggagtaaatacaatatggtatttacacatccattttgtatgggcgagatcattagacttattcgccataaaacacctttcctttcttgcaatagtgactgaacaactctattgtaacggaaaggtgtttttctgtataacgatttgactccacccgcatagcaggtggatttttgtttcgtgcatctccatttctcttttgagaaattccgatgtactcaactggctaaagccataattgaaaaaggaccagcccaagctgatcctaatcctctatcacatcctcgattctattgtctctcaaataagaagaaaaagccaagcctcatgctctgcttaatctccaatgcatttcattacaaaaatgacatcatcgtatagcaaatacataaataccccggcaccgcatgctatatgtgtaccacatccgaggcaaaccatacccttacacctcaatctcacgcccgtgaatatcggtcatacacagccggtttctcccccgcctcttcacacggtagagcgcctgatccgccacgtggagaaaatcccagttcttgttcccgttgctcgggatgtcatggcagatgccctgcgagatggtcacaccgaacgatccttccgcatagcggcgttctatatgcagtgccatcacatcctgccgcagcttctccgcgcgctcacagacttcctccgcgctcattccactgtaaataatgacgaattcatctccgccgtagcgcgcacagaaaatctgatcactttccatctgccggatcagtgccgcgatggcacgcacacagtcatcccccgcctgatgtccgtaacggtcgttgtactgcttaaaataatcaatatccaaaatctcaaacgacaacggtttatgttccgcaaagcactgttccacgatcttttctgaatcatttgtcagacggtaccggttcgccagtccagtcagcggatctctctccgacttttccgtcagctccaccgcatcctcctccagcttcctgcagcgctctcttgcccgctctaaggatttgcgcagataaagcatattgacaatcatgcttctgttttcctgttccacgatctcggtcagttcatagaatctgccagccgtcttaagatagcgttccctgtccttcgttttcttaacataatccatctctagcgctgtcatcttccgctgcatattggcgatgccggtctgctccacgaatgccttcagtttttctccgatattgcggcagacatcaccgcggtcaatctctaacatcagttcacagaaatcatacagatcatcaaacaaatccagaatcagtacatcaccggaaagctgattctgaatatccgcaatatactggtctctcatggaaatattgccacacagatgacagtaacgtgcacgcatacagtttacataaatgtaatccatctcctcaaaatgcgcttcgcactctgtctccagtttgcggatatattcctctgccttctccaggctgccgcttttcatataacacagggccagattgttgtaaatcgcggtaaggcttgccaggctgcgctcctcttccggtacgcgcttgtaatcgagatgcgcctgctccagataatctctggcatcactgtactgtccgcactccatatacagggaacccaggttactctcaatccggctttccacctcaattagctgatattttttgcaatattttaatcctgccagataatactcgatcgcaaacgacagattgcccttgccgacggatacaatcgccataagattgtaggaggctgccaccagttcccactgcccggactgttccagatatccgagtgcctcgccgatctcctcaaacacctttccggtctcattgctaagatagtaggttctgcccttgtaataatgcgaaaatccaagcagcctggcatcccccgcacgttctgcatattcctcaatctgcgtgcagtagtcaagcatgctcgccgcatccgtgccgcgaccctctctcactttctgcatcagatcttccatccggtcatcggtcttatgattttccatagcacgactccttcaccttttatctgttcgttcgcgctgcaatattttcttaacttctacacaaatacatacttccggagacgatccatcgcttcctccacgagagaaaacggcaatgcgagattcatacggatgccgcacgggctgtggaacggtcttccatcctgccagatcactccgacaccgacaccccgcttctgcagttcatcgatcgttatgccgtgctttctgcaccactctgtacagtctaagagcagcatgtaggttccctgtggcatagctacctgtacgcccttaaaatgggatctgatataatcatacgcatattctgcattcttcgtcaataccttacataattcatctgtccactcatagccttcttgctgatacgcaccaatgagtgcatacatggaaagcacgttcatttcattgtaatgtgacagcgatgattcctttttcacgcggtcacggataacgggattgtaaataatatgataacttcccaccagacccgcaagattaaaggtttttgacggtgcgtacattgccaccgtgtgcattctggcatactcagaaacactctgcgtcggcacgaattggtgatccccgaggatgatatccgaccagatctcatccgcaaccacctcaacctgatatttctcatagatctccatggcacgctcgatctcccagcgctcccacaccctgccgcacggattgtgcggggaacagaaaatcgccgcatgaatgtggttctcgcggatttttttctccatgtcttcataatccatacgccacacgccattctcatccagcacaagcggactgtgcacgatctcatacccgttgtttttcaggctgaaggtaaatccgatgtaggtcggcgaatgcacgagcactttatctccccgcgaacagaacacattgagtgcgcttaagacaccgccgagcaccccgttctcatagccgatgcattctctcgtcagcccctgtacgccattccttttcgcatgccagcggattattgcatcgaaatattcctctcttggctcaaaatacccaaatgccggatgtgcgatacgatctgtcatcgccttctgtaccgacggcaccgtggcaaaattcatatctgccacccacatcgggatggtagaaaacccctcctgcaccgttacatctttacagggaatcttatctactgccagtgcgtcttttccttttcgatccataatcgttgtaaaatcaaatttcatccttttttcctctttcttctcactgccatggtcgccgcaaagagcaccacggctgccgccgatattacggctcccgtcagaaatccggggcttttgtaccgcagttcaaactcatgtgtgccttccgtcagataggtgctgataaaagcgccgccaaacgtctcactgtccgttttctttccgtccacatacagcgtccagccatcctcatccgcgatggaaaaaatcagtctgcccgcctgtgtgacgtccacgtttccctttaccctggtatcggaaacttccgtcacttccaccgcctgtgcggcaaacgcctcataggccgtacgaagcgccatgagatccagccggtaaaccacaagctgcaccagctcattggcggtgttggtaacttttacctcttctcccgcctcacaatatcccaaatccagaatatatccgtgggaaacttttgtaaagcctctggttcttcccgagcttacctgctcctgcagattgtcaacgcccgtcttgctgtaggtggcataataatatgcggaatcctgcgcgacaaaagagctctctcccgcctttgattcggattccaccgcggtaagaagcagtctgtcgcttcccagaagattggcgagctgattctgtgtgccgatgtcgcctccgccggcatagtcccatttttccgccacatcttcatccatcatgaatcccagcggcagcacatacgcgttctcatacagatacgtgtctccacgctgcgccacaagtgtgcggagcggtccttcctccatcgcattgtccgcaagcacatagcggatggaaagcattgccgaaagaagcggtgtcgcaccgccggcacaataaaagttcttgccgccctccattccgacatcctgataaaaatggctgacattcagattcatcagggatgagaactgtgtaccggagtgatagccggacagcgccgcatcatttttggtcttgcgctccagttcctccgtccggtaaaacacggaatcttcatcacttttttccgccgtctccgaaagaaccgcccggtaatccgccagatttttcacataatccgtcctgcttatcgtgtcaagccctgtcaggttatagttgatcacaagctccgccacaaccgcaagacacccggtcgccagcatcagctgccggattctcttttttcctatgagtatgccgagtacaatcacaaaatagcaggcaaagaatgccccgcttgcccatatggaggtctgctccatcgtcgtttcgtccataaaatgattgcagaaaagcaggaatacaacgctcattccacccgctgcaaacacctgccacagctttaattcacggatgtaaagcagcgcctcataggcaatcacaagtaccagaaacgcgtacaaaaaagactgtcttcccggaagcgatgtcgggaaatgaaggccatgccagataaaatccagcatattatttgaaaagctaagccagaaaaacacgacgagtgccagccttggcagttttttcttccatggaaccgctctgttccacacatacagaaacagcagaaagagcgcaaaaattccgcagtacagattgggccagtgggaatctcccgtgtatacatcgactgccagaagggaccgcgccagctccgatacgatattaaaataccactccatcgtctccgggaacgatattccggatgcaccgcttaaggagagcacctttgccgtcggaaggatcagcactgcgcctgtggctcccgcaagcagcgaataccacgcaaagcggatccatgcccggtaccccgatgcccggtgttccatccagtagagcaaaaaccacaacaccagaaaaatgcagatcatgatcgaaatatagtaattgctcagaatgcagaccgccagcgacacataataaagccctggtctgttatcacggatcagccgctctaatcccagaatcacaagcggcgcaagcaccatgcagtccgtccacatcagattccaggcatatgccgccataaacgcgcacagcgcatacgccgcgccgcatacagccgccgcataggatgccacatctgccggaagccgcactgccgtcttcttctctgtccgtatgactgccgccgcatttccggcatcctgccacacaagaaaatgctctcccagataataggtaaacgtaagaccgctcagtgcaatcttaaggatggacagagccgtcataaattcaatcacatatcccctcggccacagaatcaaaagccagtttaacgggctggcaaggtagtacgcatacagggatacaaaatccgctcccagcccgatgttccacgaatagaacggactgcctcccgttttgagtttttccatcagctctgtaaaaaacggacaatactgatggtacatatcaatatgaagcatacactgatccccgaacggatagatttcccggttcacacagatgatcagcgtgatcagaagcggtatgcaaaacgctgccagtaacggtcctctctttttcattctccagactcctcttcccagtcaaacatgaaataatactgaagtttgcggtaaatatccatctcgccgtgctcctccttcgccggagtctcacttccgtccgcttccacggtacgcaccgccgatatcaccggatacgattcctttaatgtcagcagaaaattctgataggcatccgtgggtaccccggcgcgctttagcacctctgctcccagataatttgcgctggtatccgcattctgttcctcatcaatatcgtaattcgcccagatgacatacggcacctggtaacgcagcttttgctgttcctcatccagcgcattccactgcatgccgttcatggcgaggatcggcgccgccaccgtatcgctcggctgatgatccccgaaaaagacgatgaccgtctgctcatccacaccggagaaataatcgatcagctgctctaatgcctgatccgacagctttatcaacgaaaaatactggctgaccgatatgctgttcactccgtccaccgaaatacccggcgagaagttcgtgtaggtctggtcgtatcccccgtggttctgcatcgtcacattaaagacaaacagcggtctgccctcctccttctgctcatacagctggatgattttgtccgcacaacttgcatcgctcacataatctctgacaaaacgtgccccgtaatactgatctttaaaaatgctctgctcaaatcccagccatggatagaccttgtcacggttccagccggtggcataatacggatgggtcgccaccgtctcatacccgagcgactgcagataggatgctaacgacgggcgttctccgctcacatactgctgatacgggatgcttccctgcggcaggaacgccatcgtattcccggtcaggaactcatactccgtatctgcggtatttccaccgcacaccgagacattcaacatgccggtcacggtattttccgccccctgctgcaggctgtgcagaaacggcatatagtcctcattggtcttaaaatctcctaacacggacagatccgaaaacgactcattcatcacgacaatgatattcggcatcccggtatctgcaccgctctgcgaagtgtcatccgaggcatcttttccctcttcctccaggattgcatcgatcgactcctccgtctcctgcggttcctcgtatttttttaaaaattcctttgcctcgcctacactgtatttctgcggtttctcaatcgacatatacgcaaggttcatcacaaaagtaaccggtattccgtccacctgtgtcataaagacgggtgtaaacagcttattgtaaagcctgtgctcgttctggaaattctcctgctgcaaggttcccgcaaacatcacaagcaccgcgccaagcaccacgcccggcaggcaccgcttaaaaaatccgggtctgccaattttaaacttcaccggctgcaatccaatgatcagcgccagaaacagaattgtcacaacgatcatacgcgtatccggtgtaaagtcataattgccggacacacttaccgccgtcctccaggacagaatgtcccacggtaccagcgggttggtgcggaaacgcaccacataggcattggcaagcccgaataccagcgccgcggtaccctcgatccgatatgctgcccggagccgtccggtaatgcacaaaaaaatcccggcgagcagttcaaacaatacaatgttaaaaagctgcgcccatggccgtacctccgcaaacggattgtgtgtgtaaaattccagcaaataaaaaaatgcggcgggaggaatcaatgccacagttccccacatcacatactttgtatattttgataaagtttttttctgactcattttgactgcctcatattattttggttcttattttagcacactgcatttgtttttcctatttaattcgcaaaaaattcacaaaagcatttccgtatgttcttccagttttccacatactttgtcgaatatggctcattttttgacacatcttgttaatagaccgctttgattcgcacaattcaaacaactttcattgacatccggaagttcttcgactatgcttacacttgtatgataaattcatggaaaaggtggctgttatgaacgagaatctcgaattggaccgcttagcaaaagaaaacgataatttcaaaaaaattattcagacacagcagaataccatcaaccgcatgattgattattttattctgggcgagaaaaaacctggattgcaaaagtagctttcttcgtgtgacagtgttataataagcacacagaaaactatcttttacaacacatgatttcacggaggataaaaccatgttccaatttacagatgactgcctgatcgggatcaaggagctggacgacgagcaccgccgtctgttctcattgatcaatcaggctatggatgtactcaaccataccgattccaacgaccgctgcacccagatcacccatctgctggaggagctgacgcggtatgccgatacccattttgcacatgaggaggcttacatggagcagatccgcgatccggagctgatccgtcagcgcatgcagcactctcttttccgcgacaaaatccgcgatttttcctttgcagacatcgatgaccccggaaagcagcagcaggttgtcaccgatcttttgaatttccttgccaaatggctgtatcaccatattctcggaagcgacatcatgatcggcaagctgccgccgttagaggaatggatgatccgcgacaacccgtgtgaattcacagacgattatctgaccggcattgaaatagttgatttggagcatcagcagctcttttgcatcgtggagcgcgcctatcagctggtaaaatccaacgacgtcattacgtgctacgatgagcttttatctatcattcacgaactcacggaatataccgtaacccactttgccgacgaagaggcttacatggagaagatcggttatgaggggcttgccgcacagaaaaatgcgcacgcttccttcgtcgccagacttgagagcatcaacctgatcgagctggacgaaaatccgcaaaaatatatggagagcctgatcgaatttctgcttggatggctgatcaaccatatcctctattccgacaaaaagattcctgtccaggcataaccgctgcggacaggcacagacaatataccgtacacatttatgccgtacgcatttcaagttcttaaacatgcgctgcggatccagcatacaaaaggagctgtgaatgatattcacagctccttttgtatgctcttttcaatataatgccggcggccggacttgaaccggcacgaggttgcccccgtcagattttgagtctgatgcgtctgccattccgccacgccggcagtcttgcgatcggatctctccgtctcgctcacgcacgatttatcatatcataccctccttcatattgcaaccacatttttcacttttcacacctcactcctcttcctgatttcattgacaaaagttatcatatatgataactttatagcagacgattttttacggaacacctgtatttttcaggagaattgagggattcatgaaggaacaaagcccgcttaccccgcgctatgaggtcgtggaacagctaaagagcgcgcgcaaggcgcagaatgtgacgcaggaggtgctcgcagagcgcgtaggcaccaagaaatccaatatatcccgttttgagagcggccgttacaatcccagccttgattttctgattaaggttgccgacagtcttgggaagcagattcagatcaggattcgttaagcatgaaggaggagtttttatgacaaaaggaaagattttaggtgatattcaccagattgacaaagacgtggagctgtgccgcaccaccaatgaacgcatcagcaatcaggcggcacagcttctgattgagaaccagatcccctttacccggggctggatcaaggttccgttttttcttcgggaaaaataccgcggtgcacatcagatctatgtgatccgtacaaaccgcaaccgctacgggcaggcaagacgcaccatcgaccagctggacacttctttccggcgcagactgatcttaagcaactactgatccgtacgcacgccatcttcctgcactgtttgcgccatcagtttctcaaacagtgccaggaactttttttccacttcccgcatcggacactcccggtattccggcagcaccgccgcctgcggcgccacatcgaataatttttctcccgtgaaatgttcaaattcataatacaggcaggtatcatccatgcgctttacaatctcgcgctcccgctccgtcggcggcgcaatcaggtatttttcatagatcatctcctgaagcacctgctcaatcctgcggtattcgggcagacagcccttcaccggtctggtgatatccgacagatatgcctcgctcgcatcgtgcagcagacacgccagaacctccctgctgctgcgcccttcggcctgcgccattgcagcacagtccaggctatgctgcgcaacagaataaaataccggaaaatgcccgttggcacgtgtcattaacgacagcgcatgtgcaatatcctcgatacagatttcttccggtctaggatctgccggtgatatatgtatcccggaaaatgtgcaaatcttctctctcatcccgtttcctccatgctcttcttcaaaagacgatacaacgcggcggtatccaccggctttgcaatatgtccgttcattcccgcattcaacgccgcactgatgtcctcggtgtatgcatttgcagtcattgcatagatcggtatctccccggcatccgggcggctgctcttctgtgcgcggatcgctttcgccgcttcatagccattcattcccggcatctggacatccatcaggactgccatataggttcccggtgctgattccatataccgctccactgcttcctcaccgttccacgcatgatccacatgcatgttcacaagctccagcagctccgtgacaatctccgcgttcatctcggtatcttccgcaagaagaatccgtctgccgccaaaatcataagactctgacgcatcttcttctgcttcaccttcccccgtctcttctgctttttgctttttctcatccactgcgtgtgccagcggcagggatactgtaaaggttgttccgacacccttcttcgactggcaggagatcgatccacccatcagttccaccagattcttggcgatagaaagtccgagtccgcttccgccgtgatgctgtgccgtctcggcctcctcctgctcaaacggcaggaacagccgctcctgcatttcctcgctcattccctcgccggtatccgtcaccacaaatttatagaagaactgttcctgctgcattggcagttcgctgaccgtcacgcggatactcccgccctctggcgtaaacttataggcgttggaaatcagattcagcaatacctgattgaggcgcagcacatcgccttggacctgttccacctgtacctcgtccatctccacggtaaaggcaatctttttctgctcacactgcgttccatatactgctgaaattgaatccaacacctcttttaaggaaaacggtgcctgcgcaattttaatcttgttgctctcgatcgcagacatatcaagtacgtcatttacaatcgcaagcagcactttggatgaggtatcgatcttatccagacactcttctacccctcccccttcatcgctgcggtgtcttgcgatctcagtcagccccacaatggcattgatcggcgtacgaatctcatggctcatccgcgcaaggaactgtccctttgcctcattggcactgttggcctgtgccaccgccacagcgagctgctcgtttttctcttccagcttgtggtaatttctgcgtctcaaaagttcaaatgcaaccatccatgcgacaatctgcagcagaaggatgccgatcacggctatcggataacggaacttgtacaccatatcggagagtgtcggctcataggcggttgccagcgtgtgatccaccttaaactgggcaatctctttttctgatatcatcccaatgcacttgttcaaaatctttatcagcatgcggtgttcctcgctgtccaacccgacgattcccgtattttcctccataaaaaaagtcggaacagcagcaagttcctcataatagggatttgccagatacggcgtcagcacgctgacattctgcgccgcaaaatctgcttttccgtccaaaaccatggccagacagtcttctaagttcttctcctcacagatctcaaactgcggggcattgagctggatataatgttccagcccgacatagcttgccggaattgccagacggtatgaaacatcgtccgcatccacatcatattcctgtccgtttcttccgaccagtgcgacgtcatccgtataaaagctgtccgtcagaatatagggctccttctggaaatcaggattgtccgagagcacccctgcaaccagactgtccggatacttggacagatagtccgccgtgcgcattccctgcggcatcatcacatactgaaatgtcagaccgctgcgctctgacagcagatccagaatgtcaactgtaataccgtcgacatttccttccgcgttccagtaggacaacggtgctcttgaagcaataaacgccaccgtaatcacgcctgacccttgaatgtattctgcttcctctctggtaaagacgacctctccctccgcctccttctccccgtaatatttctgatagagatccgcctgaaacgaagctccagcctcggcaatctgcccgagcgcctcgtttacctcggcaagcagttccttgttctgcctcccagtcataatatagaacggatcggaaccgaagcggcagatgatcttgtaatccgtcttgagtgcaagacttcccatggcaaccgcgtcaatctcgccgcgatcgagcgcaccaaaacatgcctcctgcgtgtcatagatgctctcctcgtaggaaaatcccttttcggcggcatagtccctgaattcctgattctggaagctgtccttcagcattcccacgcgcatgccgttataggcggcatagtcattgtagtagtaaatatcgttctctttactcacgtacagaacactcgtctccgccccgatagcatagtccgaaaaaagatactgcttctcccgctcttttgttctctgcgcctggcagatcatatcgatctcaccggtctcaagtttttttaactgctgatcccagctgtcatactcgaattcatactcccagccggtatattctgcaattttgtgcaggtattccacaccgtagcccgtgtaggttccgtccttttcttcagtgataaatccgtcgtaatcgatatacccgactttgattacatgccttttctcctgatccgccactgccgccgtcacgctcaaggtactgcacagcacacagcaaacaaagcagatcagcgccgccacgcgtctgtatcttccggtcactcttgttcctccctcataccatgcagccgctccacaaaggataccgcaaatttctgcacatccacgcctaccgcttcctcaaagctctctcccgtaacgatcgagttggagataatgcggattcccagaaacggtatgccatacgccaggcaaagctctgccggagctgcggattccatatcttctaccgcagtcttataccgctctcttagcagtgcgatccggtccagctggttgttccactcatccgccgagccgatcactcctctgcccacataaacatccgtctgtaccttcatcgccgcatccccaagcctctcatcacacgggaaatcgagtactttccttgtctgtccaagtgttttatcgaaaatttcaatcggcagcggctcaaaatcacactcatcgattccggctccctcgggcgcgtatttccggatcatggctcccatcggaaccacgcgctcccccaccacgatgtctccccgatggaatcgcgcatcatgacctccgccaatccccaggttaatcaccgcccacaggcagaactgtgtcatggcaatggcggttgccgccgccgcattcaccatcccctgataggtgcgcgagataacgaccggctccgcgtgcttccccaagaatcccgtatagaatttccagttgccgcaggttatctcctccggttcgtcaagctgtccgatcagatactccgtctccgtgtccatcgctccctgaatcagaagcaccggctgttttttgaaatcgtaatttggcatgttttcctcatttctgtcttttcttctagcacattctcatttctgttgtatctactatacgttgttaaacttcccgatgtcaagggacgtatttttttcttgacggataccgctttctgttttaaggttttagtataatcagacaggaggatttttatatggaaaaaattgccagctttaccatagaccacatcaaattacagccgggtgtctatgtgtccagaaaggatcatgtcggagcggaagtcatcactaccttcgatcttcgcatgacctcaccgaacgacgaaccggtcatgaacacggcagaagtgcacacgatcgagcatctgggtgctaccttcctgcggaatcacaaggacttctccgataagaccgtctactttggaccaatgggatgccgcaccggcttctatcttctccttgccggggattacgagtcgaaggacatcgttccgttaatgattgaaatgtttgaatttatccgggattttcggggcgatgtacctggtgccgcaccaaaggactgcggaaactatctggatatgaatcttggcatggcgaattatcttgcgaatcgttatctggagaatactctgtatcacattgatgcagcgcatctcatctatccggaataaaatcttatcaaagaaaaagggtgtaacgtctcaatctctcaataaagactttacaccctttgttttttataatttgatttaaatatcgtccagggattctttgatcttatccatgaatcccttctttttcttaggcttctcctgcttatcggaagaacctgccccgtcctgggcgccggttcggtttaaggaatcacccgtcagcgcatcaaactgacgtaacgcctcctttgcgtctgcggaaagcccggtcggtgtctgtaccaccagatccacatagtgatcgccgcgaaccgatttgttgcggagcgacggcacaccttttcctttcagacgaattcttgtgttcgtctgtgttccaggcttcacttcatacaacacatctccgtccaccgtatgaatacggatctctccgccaagtgctgcctgggcaaaggaaatctgtgcggtggaataaatattcatatcctgccgctgcagggtcggatgtctcgatacgacaacctctacgagcagatcgcctctcggtccgccgttgattcccggctcgcccttctcccggatacggacgctctgtccgttgtcgatacctgccggaatcgacacctgaatctttttcttgcttgcaatgtatccggtaccccggcaatccgggcacttgtctttgatgatctttccggaaccgccacagtccggacaggtctgcacattctgcaccgtgccaaagaaagactgctgtgtaaatacaacctttcccttaccgccacacttcggacaggtctccggcgttgtccccggctttgcacctgttccatggcaggtatggcactcatcctttaacaccatctcaatctctttctcacatccgaagattgcctcctcaaatgtgatgcggacactggttcttaagttggagcccttcataggaccatcatttgttcttcttctggaaccaccgccaaagaaatctccaaaaatgtctccaaaaatgtctcccatatccatgccggagaaatcgaatccgcccgctccgccaccggtgccgtcaaacgctgcatgaccaaactgatcgtactgctttctcttctctgcatcggaaagcactgcataggcttcctgtgcttccttgaacttttcttcacactctttatccccagggtgcatgtcgggatgatactttttggcaagagtacggaatgctttcttgatctcatcgtccgatgcggtcttgcttacacccaagacctcataataatctctcttatccgccataacttttcctctattcctctctactgcacacggggtttccagatgtcaccatccagaaaccccatgttttatacactgcgttgaaatatcgtaacacactctggcttctttgtaaatgccgcagcttctgtcagattatacttccttgaagtccgcatctacaacatcgtcgtttgcagcgcctgtgcttcctgtgcttcctgcaccgcccatattgctcatatcaggacctgcgcctgctgcaccctgtgctgcctgtgtctgctcatacatctttgcaaataccttctgtgcactctgtgtcagcttctcctgcaaggattttaactctgtcacatccgcctctgtcatctcttctgcattctgatgtgcatccaggaatgacttcactgcattcatgtcgttctctacttccgacttatcggctgcatccaggtttgcgccaacctgatccagtgcctgctgtgtctggaatacgaaggaatctgcatcatttcttgcatcgattgcttcttttctcttcttatcctgtgcctcgtactcagctgcctctctgactgccttatcgatctcatcatcagacatattagaaccagctgtgattgtaatatgctgctctttgcctgttcccagatcctttgcggatacgtttacaataccgtttgcatcgatatcgaatgtaacctcgatctgcggtacaccacgacgtgctggcgggataccatccagacggaactggccaagggacttgttatctcttgcaaactgtctctcaccctgtacaacgttgatgtctacagcggtctggttgtctgctgcggtggagaagatctggctcttcttggtcgggatagtcgtatttctctcgatcagtcttgttgcaataccacccatggtctcgatggacagtgacagcggtgttacatccagaagtaagatctcacccgcaccggcatcacctgcaagcttaccaccctgaatggaagcaccgatggctacacactcatccgggtttaaggatttgctcggctctttgcctgtgagctgtcttaccttatcctgtacagccgggatacgtgtcgatccacctactaacaatacctgacccagatcagcgttggtcagtccggcatctctcattgcattctgaaccgggattgcggtcttctctaccagatcatgtgtcagttcgtcgaactttgctctggtcaggttcatatcaaaatgcttcggtccctcagcagttgctgtgatgaacggaaggttgatgttggttgtggttgcggaagaaagctctttctttgccttctcagctgcttcctttaatctctgaagtgccatcttatctgtggataagtctacgccctctgccttcttgaactcatcgatcatccactgtgtcactctgttatcgaagtcatcaccgccaaggtgtgtatcaccgtttgtagaaagtacctcgatgacaccatcaccgatctcgataatagatacatcgaatgtaccaccgccgagatcgtataccatgatcttctgctctttctcattgtcaagaccgtaagcaagtgctgctgctgtcggctcgttgatgatacgctttacatccagtcctgcgatcttacctgcatccttggttgcctgacgctgtgcgtcgttgaagtaagccggaaccgtgatgactgcttctgttactttctctccgaggtatccttccgcatctgcctttaacttctgcagaatcattgcggaaatctgctgcggagaatactgtttgtcatcgattgctaccttgtaatcggttcccatatgtctcttaatggaagagattgtcttctctgcgttggtgactgcctgacgctttgctggctcaccgacgagtctctcaccggtcttcgtaaatgctacgatagacggtgttgttcttgcgccttcctggttggcgataacggtaggttttccaccttccatcactgctacacagctgtttgttgttcctaaatcaattccgataatttttcccatgatagattcctcctcatcatattctaaaaacaaatttgttacttttgctgcatttatattaacgcggacatcttacgatgccggcacgtctgactgataaaacggctgctatgataccactgcaaccatgctgtggcgcacaacagaatccttatacatataacccttctgtaactcctgtgcgaccactccggaatcgtactcctcgctttccacctgcatcactgcattgtggaagttcggatcaaattcctgaccgactgcctcgatcggctttactccgcttgcatcaagctcggtaagcatctgtctgtatactttatccatcccgacgacaaacgcatcttctcgctgctcctccggtactgctgccagtcctctctcaaaattgtcaatcaccggaaggatcttctcaatgatactttttgctcccatatcgtacatctgtgttttttctttctctgtgcgcttacggaagttgtcgaattctgccatctgacgttttaatttatcattcagttcctcgatctgttcgtcttttttatctttctttttcttaaagaatcccttcttctcatcggcaggtgcttcctgtccgtcctctgcctcagattcctctgtctcttctgcctgctcgccggattcagctgtttctgtttcagcctctgtctcctccgcctcgcttacctcttctgcctgcttctctgcggcatctttttcaagatcctctaatacttcttccatcatttcttcttttttctctgccattccaatcctccatctatgtctcaccttttggtctgtccaaaattccatcgagagaattcttcaataccttcaggttatccatgactttctcataatccattcgcttcggtcctacaataccgatggttccgcgaatcccttctcccaattcataggttgctgtaaccacgctgcagtccttcatcgtctgaatcgggctttcatttcctatataaacctgaatccctgtgctcttatcttccaacaggttctcagtgacaagtgatgcaagctgctgcttctcctcaaatgtggagatcagttcactcgctttttctgtggaatcacttaactccgggtatttgaacaggttcgttgtcccgctcgtatagatccggatatcctcatcctgtcccatcgtctctgccacggtatccagcacatcactgatgatgtcgctgtggattcccgcctgctccttcaacttggcgatcgtgccgagattgatatcctgcaaggcaagaccgttgagattcgagttcagcagaatatttaacttcagcatcgtctcattgtcgatcggctcggatactggaataatcttgttcttgaccagattaccctccgtgacaatcactgccagtatctgttcttcattcacattggaaagctgtatgaactttaccttgttgcggtggtagctcggtgccgacaccatcgtcgcatagttggtatttgccgccagcatctttgccacctgctgaagaacctgatctactttttccgtgtgttcaatgacgaacttcttcatgtcatctacctcacggttcttctcttccatcaggtgatctacataaaaccgataccccttatcggaaggaatacgtcctgcggaagtatgcggctgcaggatataacccagttcctccaggtctgccatctcattgcggatggtcgcagaactcagattcagatctgtatattttgaaatggttctcgacccaaccggctcgcctgtctccagataattgcggatgatcgcatctaaaatttttactttacgttcatctaattccatctcgtccatcgctggtctcctgctgcttttcctgcagttccttttgtcttattagcactcgttgctatggagtgctaacaccttacgtacttaagatagcaccaacctatttctttgtcaacaggatttttcataaaagttgtgttttatttgtgattttatagtttgtttataaatagaaaaaatcctccgaaggttccatgtcctccggaggattcccgcatcactttcttctattataatagaatacacatttctctccatctatatccgcccgtcaggcggaaaacttccgctaaaacggtcggaaacagcaacagttgcagaggagatccagacagagcaggcttaagcaccagttccctgcgctcgcatacggtctgtcgtagtcacttcccatgctggtataccatgtgccgccatactgaagatgctgtaaaaactgccggtattccatattgctcggctccatctccaccgcacgctttgcgtgttccatcgcgttgatgttattgcccatgccctgattggcaatcgcgctgaaatagtaccagcgcgcccggcgttccccaaacggaattccgttcagcacattcaacgcctccacatagtgtctgcttgcaatataatttgcagccgcctgcatcttcggcgattcattctgaccgaatccatggctgccggcgtaactgtaaccgccggaattgctgctgtagccgccgccataaccgtatccaccgccctgctgcttctccttcatgatctggtcatatgcctgctgtacttccttaaaatgctcctcagcctcatccctgttcggattgttcacattcgcatctggatggtattttctgctgagtgctctgtatgccttttttatctcttcatctgaggctccccgcgatacgccgagcacctgatatggatctgtcatatatgtgtaacctcgctatttgcgcgcttttttcttattcttctcttccgccttgcgttttttcagctgaagatactcgtattttgaccatacgccggaatacagcacattccgcagtatatccgcatgtaataaaatcggaaggcgctcaaacgacttggcgcactcggacatcatgctcgtgagcagcagacggcagagcgtatccatgtcatccgcactctcccgcatcgcatagacgagtggattgtactcctttttcctgcgatcctcatcgtaatcctcataggcatccataatgtagatgaactttcccatgtaaaagccaagtgtgcgcagctcttcctgccactcatcctctctccagcagaaaatctcacccagcatctctccggtcagacctgccaccacatcaaggttcgtctcgcctcttgcctccacctcgtctgtttttcgcatgaactcttccactgcgtgaacctggcgcggatacttctctatcacgcgcgcatagtccttatccagcatctttgcaaacgccttcttcgtataggctttctcgtccttccagtcgtcaatcagattatgataggctacaatcagattcatatccgccgcataatctgtcgcctcattgatccacacctgccgcttcctggtcggatgcagcgcgcaggtaatctcggaggattcattcgtaagctcatacaagcccgtcagaagaacgatcagaaatgtcatatcatagttgagcagcatctgtccttttgcaccacagttggatttgagtctctggcacagtccgcagtaatatgcctgatatgccttccggttctcctctgtcatgatcttctgattgatatttatgtaaccgaacattccaagttctcctttgccctgccagatcagcttcttctgatgaattctctcctgcacttcgggcaggtaatacagattttgcctcttcccttcggcacccgcactctctgcctgcatccaggacacttgaaaaagcggtaggtatctctctgtgcgaagcgcttcttccactgatcccgcttcacaactgctttgtagcgcctgctcagataccgctgattctcctcgtaacgcttcgagacgttctttgaaaacatacggaaacaattataaatcatcagcgcaattccaaaccagtaaaaaatggaaagcaccggcagaagcccgctaaacatcgacacaaccagactcaccaataccacgatgttcaaggttctcccaagctcatccgctccataccgtccagtcataaaacgctgcagtttttctctcatatccattccttcctttccggatcatgagatcatgttaagccctgcaaaatagactgtcaaccttcctatcgtctttttagaaacattttagactttgattagatttcaggctgcctgtcaaaacaggcgcacctttctcctcatatcctccggatcttttgctcctgcgatcgccgtcccggacgtaatgcagctcttcatataaagattgtaaatcgcatcatccatctgcactctgccacgctccttctctgctccggcggacgtatccagctgctgtatccggttctccgcaatcagactgcgcaccccggcatccgccaccagaacctcataggcagccacgcgcccggcttcatcctgccgccgcagcagcttctgcgccatagcccccgccagtccctgcgccagactttccagaaggatctgcgaaccggatgtgctcccgccgcactgtaccagatggagcaatgccgccgtcacactgtcctccttctctgccagaatcacaaactgccctctcctgactgctgcaaacaaaagcccggcctcccgctcattcccgattccatccagaaggatcacatcggcatcctgctgcagcgccatcgcaagggcttcctccctggaagcgcagtccgctccgatctcccgctgcacaaccagtccccttccctgcggaaggatgtattctgtcgtatcctccacagagacaatgacctttgactgtgttgcggcaatctgtgcggcaagtgatgccaccgtcgtcgtcactccgcttcctctgcctcccgtgacaagaagcagcccgcgcccgtttttcacaagctccgtaatctcctccggtaacagaagtttctccggggcaggaaccccggtcggatgcagtcttacggacatggcatctcttccctgctgtctgtatatggacacacgcagacgcaacgctttggaaaatgaatagctacataccagcgcgcctttcgtgcggtactcttccagctgatccccggacaagatctgctccgtcacctctgtaagatccgcatcctgccattctgcggcgtcctcctgccctgcggcagtcagttctccgtcaatccgaagcatcgccgttcttcccgggacaaggtgtacatccgatgcacctttgccatccgcatattccataagatcattaaaaagttttatgccgttcatagaaaaactccttcttattgcttcatagggaaatgcaatgcatccccgcagagcgttttttatttctaggaaggttctactttcacacattaatgtatcacggtattccctatgaaataaaaagagccgctgcgcgactctcagatacttctatgtgacaatgataagcagaacgataagccgggttatgtctaaaccgtggcaagccacagtcggaatgatcatctatctaggatgactgttgccagccacctcaagcaacctacctaaagctggcgggccgcgtcaacgcttttgttcggtcttgcttcggatggggtttacatatgcccgctctgttaccagcgcggcggtagtctcttacactgcccttccacccttaccgtattccggcattaccggaaccggcggtatatttctgttgcactatccttggagtcgcctccaccggacgttatccggcatcctgccctgtgaagcccggactttcctcaccccagcaatgctgggccgcgatcatttgttctacttatcaccgcaactattgcttattataatgtgctttccgcaaaatgtcaaagcaatcctatacattgaagcaggaaccgccgatgaattcgcggataatcgaattctggctgataccgtcgctcggcatcggaaggaaataatccagaaacttgagcaggcgctttgcctccagatattccggacaatccttgtcaatggcaaacagcagcggctcggcatacatctttaacactgccagttcatagatcagcgccgagttaaacatcacgtccgccccctcctggaacgggaaaatgtagcgctcctcaccgcggcgcaccgaatcccacatggcaatggtctcctttgcggaagttcctctcgtgcgcgcatctctcacaatccggcggatcattctgccgtccgttgttggcaggcagttgtgctcgtcgatgttgagctgggtcagcgcactgatgtagattttgaacttgctctccaccgggagcgagcaggacagcctgtcgttgagtccgtggattccctcgatgaccagtacgtcctcttttccaagttgcatgtagcggtccttgtattcccgcttgccggtcttaaaattgaagaccggcagattgacgcgcttgcccgcaagcagttcattcatgtcgtggttaaacagctccacatccagcgcttccagacattccagatcgagttccccgttctcatcgcgcgggcactgatccctgttcgcataataatcatcgagagggaacggatgcggctttaatcccttcgcagcaagctggatagaaaggcggtgtgaaaaggtggtctttccggaggaagacggtccggcaatcatgataaactttttgcctcccgactttacaatcgtatctgccagatgaccgatccgttcctcaaacagtgcctcctgcgtcagaataatttcctgcatgcgtccttccgcaatcgcgtcattaagcgcgccaatcgtgccgatctctagcatgcgcccccactcacgcgaagccttcagcgtgtggaacagcttcccggaaggtgcaaactctgccacttctcttgtattctcattcgggaacagaagtacaaatccatcctcatacgtcacaatatcgtagtagcggagatagcccgtagacggcaccatgaatccgtaaaaatagtccttatagtgatcaagcacatagatattaactctggaactgcggcggtatttaaaaagcttttccttatcctccatcccgaggtcatggaacagtgcaatcgcatcatctgtgttcatgctgcgcttctcaatctcgatatcctccgtcaccagacggtacatctcctttttcagcgctatggcgcgctcttcgtccaccgcaatcacgcgctcctgtccgtctgccttttcacgcagctcgcagtaatatccctgaccgatggaatagagtacacggacgctgatatgttcgcttccccagagattgtagaccgccttctgcatcagaagcgtaacgcttctgcggtatgtcttttttcccgtcttatcggctgttgtcacaaacgaaagcgttccgtcccgctgtgccgtcttattcaattcccgcagccggttattatacaccacaagcacgatgtcatccggatatttttcctgatattcctgcgaaattgcaaggaaactggttcccgccggatattgtcttacttccccttcaattgtcaagctgaccatatctttccccatacgaatctctccccctctgccttttcttcaaggctttttgtcattcataatacgcaagcgccctggcgttctgcgcgaggatctgttttacgtcgtcaatccgggctgcaatctgctccgtcgccggctgaccggatagctgtgttaaaatatcctgctggatctgcgcttcccagcggagatacgccagaagcaccggatgtttttctgtaagaagctgctttccatagcggaattccagttcctgttcttctgtaaagctgtctgcatgagagactgcggaagcatcaaagtgaacgcgcatcatggggtaatattttccatcctccatgaccatctcttctctctctgtgacataaccgttctccatcagaaaacgccgcaccttcggaagctctgactgcggctgcaaaaccagcccatgtgcctgctcacagatgactctcccgctctccagaatatgtttgaccagtccgccgcccatccccgcaatcaggatggtgtccgcctcacccggctttagcgccgcaacgccgtccgacagacgagtctgtatgtagtcttccatgccgtacatccggatgtgttccctggcacgctccagcggtcccgtccggatatccatcgcaatcgcactggggatgtgctttcgttccaccagataaatcggtacatacccgtgatcggttcccacatccgccagccgctctccctctccgatgagtcctgccgccgttcttaaacgttctgatatttttaccatagattactccagataatcctttaatttgcggcttctgctcggatgacgcagcttgcgcagcgccttcgcctcgatctgacggatacgctcacgtgtgacattgaactcttttccgacttcctcaagtgtcctcgcacgtccgtcctccagtccaaaacgcagtgtcagcaccttctgctcacgctctgtcagcgttccgagcacttcctccaactgttcttttaacagggtaaatgccgctgcatccgccggtaccggaacgttgtcgtcctggataaaatcaccgagatggctgtcctcctcctcaccgatcggagtctctaaggataccggctcctgcgaaatctttaagatctcacgcacacgctccaccggcatgttcatctccgcagcgatctcctccggagtaggttcgcgtcccagctcctgcagtaactgtctgctgacacggatcagcttgttgatcgtctcgaccatatgcaccggaatacggatggttctcgcctgatctgcaatggctctcgtgattgcctgacggatccaccatgtcgcgtaggtggagaacttatatcccttgcggtaatcaaacttttccaccgccttgatcagtcctaaatttccctcctgaatcagatccagaaacaacattccacgaccgacatagcgctttgcaatgctgacaaccagacgaagattggcctctgccagtctctttttcgcctcctgatcgccgagctccatacgctttgccagctcaatctcctcctccgcggacagaagcggcacttttccgatctcttttaaatacatacgcaccggatcttcaatggagacaccgtccggaacggaaagatcaatcttctcgacctcaatctcatcctcatcatcgacgtcaagaagcatctcatcgtcaacgtcgtcatccgtaatacgaagcacgtcgatgttgtttgcctcaaggaaatcaagaatcttctcaaactgctctgcatccagctgcatgtcggaaaagaagtcgctgatctcctgatactccagcatgtttttcttcttttttgccagcgcaagcagttctcttaactttatctggaacttctcctgggcacttgccaccccgttctctgctcccgcatcggcagtttttgcagcagagttctccttgttttctcccagaacttccttattgtcggtgttttctttcttttttgccattttcgcttcatcctctcatagttcgttactattttgtccttaaatgcagattttcatccacattcctgcttctttgcccgctctcattcctccagcggaatatgaaccgttcccggcagctcattcttttcttttgccagagccgccatctcctgaacgtcaaacgtgtttgccagcttatgattgatgctgttctcccgcacgcggatcacggtctcgcgcagcgctttttcgcgttcctccctggtatccacccggtggattgtcgcgtttaagattcccgctgcctcccgctgctgctcctcatcctcgtaggtgctgatgatccgcgcaggattgactgtcccgtccttctcatactgttcaaacagcatttttgccacactgtggcagatcggatccgtaaaatcatctgcaccaacatatctttgcacctttggaaacaacgccggactgttcgtcagccacgtcagcagaagcttctgcgactgcaccatgccgtcctcgcgctttttcgcactctttttgtattctgtgcgcgcaccgtcctgtgcgtccgcgacgctctgcgacgccctgcctcctccggcaagtccggcctttaatccctgctggttgaccagccttctcaaatcgtccgacgagatcatgtatttggctgcaaccgcctcgatataattatcgcgctctaacttctccgtaaatccgcaaagcatcttcgcgaccgcattgtaaaaggccgtcttgccctccggatcgtgcatgtcgtgctgctgctcttccatgcgcacctcaaacagaaaactgttctccgcctggtcgatgcgctcctgatacgcctccgcgccaagcgccttgataaactcatcgggatccttatacggcttcatgttgatgatcttggtcgtgattccgacttcttttaaaatcgggatggccctgagcgccgccttgatccccgccccgtcgctgtcatacgtcagatagacttccttggtatagcgcttgagcagattggcatgaccgcttgtgagcgccgtaccgagcgacgccacggcattgtcaaaccctgcctggtgcagtgcaatcacatccatatatccctcgcacaagagcagctgcggcttttttgtcgcccgtgcgaaattgagtccgtaaagattgcggctcttgtcgaaaatcttcgtctcgggggaattgagatactttggctctccatctcccatgacgcgcccgccaaatccgatcaccttattgtgcacatccatgatcggaaacatggcacggttccagaacttatcatgtccgccccgcacctcatcgatcgtgacaagaccggaatcctttaagatctcgtcgtcatagcccttcgaccgcagataccggtacagatcatcgctgtactgatccgaatatcccagcccgaacttgtggatcgtctcatcggacaacgccctctttttaaaataatcaagcgcacgttttccgcgctccccgcgaagcagcacgaaaaaatactttgccgcctccttgttgatctccaaaagacgcgcccgccgatccgcctcctgccgctgcgctgccgtatattcctgcttcggaaggtcgacgcccgcccgctcagcaagcgcttccatcgcttccccgaacgtgtaattctcgtactgcatcaggaaggtaaaaacattgcctcccgcgtggcagccaaaacaatagtacatctgtttattgggagagaccgaaaaagaaccggtcttctcattatggaaagggcacagcccgaagtaggtactgcccttttttgacagccgcacatactgcgaaatgacgtccacgatatcgttgcgcgaacgcacttcttctatcaattcatccgaataacgcggcatcttccgctcctttcttcccgctttttatttccattctaatagccgtccacctgccaggccctgggacgcctcaggcatgacacagtcttaatagccgtccacctgccaggcctgaggcaaaaagtactccgaaaacttggtgatggcatactgatccgtcattcctgcgatgtagtccgcgaccacgcgctccgcgctctcgccctcgtccatcatgcgcagatattttgccgggagctgatccagatgctccttgtaaaagtaaaagagctgctcgatcatcgccttcgccttgacttcctctccctttgccacagggttcttgtagacgttctcaaacatgaacttgcgcagatcgatcatcgcctcctcgatctccggcgacatcatgatgtcatccttctccctgctgttcatgataatgttatgtatcagcgtattgaggcgctgcttggtggaaaaaccaagggtctttctgagttcaagcggaatatcgtcctccgttaagaccagcgcacggatcgcatcgtcaatatcgtggttgatataggcaatcttatccgaaaaacgcacaatctttccctcgagcgtatgcggcatcagtctggactgatggttcaaaataccgtcccgcacttcccatgtgagattcagcccctttccatccttctccagcttctccacgatacgcacactctgttcgttgtgccggaatccattctcgcagagcccgtttaacacgaactcgccggcatgtccaaacggcgtatgcccgatatcgtgtccgagcgcaatcgcctcgaccagatcctcattgaggcgcagtgcctttgcgatcgttctggcattctgcgatacctcgagtgtatgggacagcctcgtccggtaatgatcgcccttcggcgtcagaaacacctgcgttttgttcttgagacgccggaacgccttgctgtgcaggatgcggtctctgtcacgctgaaataccggtctgatatcacacggctcctcatacacatctctgcccttagaatgaatgctgagcgtggcgtacggacttaaggtctcgcactccattctctctatttcttcccgtatcgacatgtattatctcctctttttcgtcacgcactacgcagtgactccatatatataattctgcgtccggagtggatttcctctatttttttcgacacagtttgaaaaaatcatgtttccttgcgctaaaaatgctatactataaccaccaaatgaacaaggagtgtggtaccatggttttatttctgctcatcatccttattatgatttcggtatattggagaccaatgtggggaattctaagaggtctgctgctcggctttctttttttaatcgggggcagttctctgaacatcccggttccggtttcgtttgtggtatttgttctctactgccagctgggcaccccctggcttcgcaagacaaactaccggcagacaaaagcgacaagaacatttcacgaatcgacaaccaccgacgcggatcactccacgtacaccacggagcagtactattatgcctatgaggtggacggcacggattataccaacgtgcatagcatctatccgtataataagaagctgcatgcggaagccaaaagcgcagaatgtgaaattttctaccatccgaaaaagccgaagaagatgttctgcccggaagatatcgcaaaagattactacacgatatggattctccggttcctgatcggcggcactatcattgcaacagatttttatttttaatttattataaaatgagaaaggcaggtcaataagcatgaaaataacaatcgcaagacagtgtggaagcggcgggcacaaagtcgccgacattctgtccgaaaaactgggtatggagatttttgacaaaaaaagatttatcgaagagtctaaaagaagaaacgtctatgatgaaaacgcaaattttctgaacgagaaaccgatcgacagttttctttacagtcttatcatgagctacggttccaaaaatccgcgtgaacgatatatccgttttgtaaaggatgtcacggagcaggaatcctgtattatcatcggcagatgcgcaaacataatctacaaggatgacccggactgtgtgtccgtttatctccacgccgatccggacatacggaaaaagagaatccaggagcgcgaccacgtatctgaaaaagaggctgcggagacattgcgggaagtagatgaaaagcgttctgcatttcaggaacagtgcacggcaacccgctggggcgacggcaacgagtatgacctttgtattgatacagggaaaatcggtatcgagaaagctgccgaattaattttgcagtatatagaatacaggaaatgaaaaaacgggaagccttcactctcaaggcttcccgcaaataaaaaatgcaggagatgggacttgaacccacacgatattgctaccacaggcacctgaagcctgcgcgtctgccaattccgccactcctgcataatctccacgaatatttgtgatgtaatgcggaagatgggacttgaacccacacgttcgcaatgaacacaagatccttagtcttgctcgtctgccagttccgacacttccgcatttcggtcactcatcgtgacgacttgataataataacaaacgtattttaaaatgtcaatgcttttttcaaaaaattttaaataaattgttcaaacaattcgtgcaactacagatatttctcgtcaaactcctctttatgcagcggctttccaaagtaaaatccctgaatcaactggattttcgtctgcttgagcgcatcaacctgttctttcgtctcgacgccctccacacagacatgaacgccgatcgtctgggcaagttccgccaccattttcacgaaggcggcggaaaattcatccttcccgatgtcaatgataaaacagcggtcaatcttgatgacgtcgatcggcatttcccggatatgattaagtgaggaataccccgtcccgaaatcatccagcgccacacgcacgccaagtgcgcgaatctcggaaagaatcttcttcatccggctcatatcgttgatcgccagcccctccgtgacctccagggtcagattctccggtacaatccccgtccgtttgatgaccgagcgcacctgctctacaatgtcattctgcagcagctgcaccacggagagattgacatttaccttgtaatccggatgccccatatcgttccagtatttgcaccgcttgcacgcctcctcgaggacatacgcaccgatcgggttaatcagccccagatactccgccagcggtataaaatccgtcggagcaatcaatcccagttccccggaattccagcggatcaacgcctccgcacccacgcacggattggattccctggtcacatccacgatcggctgatagaccacctcaaactcggaaaatgcattgttggtcgcattgcgcatatttttttccatatcgaggcggcggaacgatgtggactccacgttctcatcgtagaactccacacggttcttgccggaacattttgcggcgtaaagcgcaatatccgccttcttgatcagctcctccaccgtgtcgccctctgtcggaaaacgcacaacgcccatactcatcgtacagtagtaatccgcccccttaagcatccacggcttggaaaacagcgtgcggatgtcgttcagaatcttctgcagcatcatgatctgccgatgtgcaagaataatgataaactcatctccgcccatgcggtaacagttattttccacacccggaatccgacgcaggctgtccgatatattttttaacaggatatccccgtactggtgtcccagtccgtcgttgatatgcttaaaatcatcgagatcgatgtagagcagcgctccttcgccgccgaactcctttgtctgttcaatgcagtgcgcaagatcctgctcaaaccgcatacggttgtaaagcccggtcaaaaaatcgttgtttgcctgccgttcgatcttctgctgatacagctttttgtccgtcacctcatagatggtatacaaaaatacacttcttccgtcgacccagtggattcctgtccggtgatagtcaaaccagcgtttttcctgctccagatagatctcgtggaagcagtccgtatcaatgccgcccgattcttcccgccagcagttctccaacatgtccggcgcggcatcgtccggcagaaatgcgcgcagccgctggttgctgtagagaatccttccactgaccggatccttcacatagattccgcagcccacgttctctaaaatcgcctcaagggacgcatacgaactcgccaacgaattttttgcaatacgcttcagaagaatactctgaataatccgtctgacatcgttgacgaacttgacgtccgtcacttcccagttccgctcctcgtgttcttccaaaaagcacaggtacatctccgccctggtattgacctcgaccggcagaaaaatgcctgccaaaagcccgtgcgcatcaaaaaactgccggaacacctccggcatcatactgtttgaagaaatcatatacggttttccgttaaaaaagggcatcttctcacgcgacacgccggaccattccccacgcactgagtccattccgggcgccgcatattcacagatcatctcgatcttcgagtgctctttgttctcttttaagagcgcaccgcgcgaaatctccatatacgcgcagcattcccgcagaatgtcgtgcacgatctcctcaaagctgttttccgactctaacatctttacgatggaagtcatcacctcattcctgtgaagttccgcttccatctgcgtctcagactcgcggctctttaacaccgcctcctgtgccatcagttcttccatcttcacggcgaacatctgcttggacaatgtctccagaaattccagtgacttatcataccgttccggcgtcgtgcgcatgacataagatggaacatccccgccttcccgatccataattccgatgacgatccagattgccgccgtcttcccgccgatcttgatggacacgccgcacattttcaccagatcatttccacaatcctcttcgagcacactttcgattccgtcatctaaaagccggttcatgagcgtcatatgccgttccactccggtcagtccgtgaatgtacgccagttcctccttagaaccgtatgcctttgtgacaactccgcgcgttctgctcagacacaccagatacacattattggcatcgcaaaaccggtcctgcagattctgcatcaatgtcgcatctaacaatcccagatcggtatcctgcgacgcttcctgattcatcccccttgaaagtgccatatcttcctcatcctttatactgaattacaaacagataaaactgatccttttcccggatacactgctcggcaagcagccggtaagcgcttcttatgcgaagctgttttctgataaatccctgctcattggaatagagcacaagaattccgtccgcttttaaaagtccggctgatttttcaaaaaatctgccgtaaaaagtgtccgtctcttcctttgactttcttccccggacaggcatattggtgatgatctcgtcaaatagatatgcatgtgtaaaatcaaaataatcacggttgataaaattgattttctcccccgcatatgatgcattctccctggctccccggatcgcctcgccaaagatatcaattccgtatttttcccgtgccgggacacggatatcccgctcgatcaacatcgtgccgacaccgcagaacggatcgagaatctgcgcgttttcttttaaatacggctctgccagcgccacaatcattgccgccgtcgccggatgaatcgaagctgccaccgcatttttgcggtaggcaaagcgtccatgcgcaatcgtaagaagtttcagaaagcaggcgtaaccgccgtctcttttctccagaagccgcagttcaatctcataatccgacggtgcattcacaagcatcctgccggacagccgctccagctccgcggaaaaccgtctggcaaacgtgctctttttgtctaacggcatgtggctctttatttccagtctgaaataaaacggcgtcgtctcccggtgcgcctgtgtaaggagctcccgcagattggaatcccagaccgcctccgcggctcctaaggcatcttccggcaccggctgcgccgtgcgcaccggaaacaataactcgcggtaagtccttatcgacgcaaacgggcggacgtccttcgcatgaaccagcacaccgagcgggtgcagtttctcactgcgtctgaccgatgcggacaccgcttttacctcctcaagcgtcacgccgcgctgctcccggtttgtcgcgagcagaaaatcctgcggctctgtgaatcccacaaacgtgtgacgggtaattccctccgccgccgtaatgatacgttccagttctcgcagttcctcattcacatgctttttctcattctcgggaatctcccgcgccaaaagtgcatccctgtgttcttttaacgcttccagatacggggatacctccatccctgacaaagccgtgagatacgcgctccttacgaacagcgtctgctctctctcgtatgcatgaaaaagagaacctgccgtctgtaaaagcccgagacttccaagcagaagcgccgcatttttgcgcaccttcggctcatcgctctccagcagtcctgtgagcagtgccccgtctcccaccagagacagcagggtttcccttgcctgtgggtccttgcactcgcttcgcagcagactcaagttctctcttatattctgattgttctgtaattctttataatattcgtgaatcataccgtatacctactacccttgatactaggtattctacgatatttcctcatttttggcaataccattcacatcaatgtaggtcagcaggtcctgcttgaacacaagccacgcatcctcatgctccacatagtatttcgggcacattttccccgtcacatcataatggcggatcacatcatccgtagtcaggtcatagcgtcccatcagccaggcggtaagctctatcagcgactggtaggtcgcatcggtaaactctcccgtctcatccggaatacagcactcgatggctatcgtgtcttcattccggtcattcgacgcgtaggcaatctcgttgcacggaatgcactgcacaatctccccgtccatgccgatgacgaaatgactgctggcatacgtctcccctgtgtctttcagattctcaaaatagctgcggttctgctccgctgtcgtgcccggattcgcagtatagtggatcacgatgccgttcacctgggaaagcgccgttcccggccgcgaatattcgttgtaatccagcagttctacctgatagtccggcgcctgtgccacatactttacctcgtacgccatcaccggcttttcttcatatagaagctttttgatctgtcgtgtgccaaaccagaccgccagcaccaaaagcagcggaatgccgatcaaaagcactatgcgcagccggcgtcttctccgaagccttttgcgccgtctacgccttttctcctcatacctacgccgttcttctcgcctgtatttctcttcctgttcctctcgcattgctccatcttcccatctgtccgttcattctgtcgtgctctctctgcggttccacgcgcgcctcttttttcattatgcacaattattttcgtgattttttacaaaatttttactatctttttgttgctttcttctaaaacaagtgctatactctgtcaaggaaaaagaaaggaggcgtatcacgatgaaatataccatagatccaactatgacttacagcgaagcagttctcttttatgaagaatatctcactgctgccaaggctgctgggaaaaagccggtatctttcctgcactttatcacaggtcgttactagaaggcttttcccttcttttttatcttacatcagatgagaatttctgtgttttaaatttgtcttaatttctcttaatttccactgaacttttaccgaataaaatttgttttcattgcaggttcccgctccgggaatgtgattcccgctgccgctcctgcctgaatacatttgagcagccatgccatattgctgcccagcgtgcgcatggtctgcagtccctctgcgtcctgccgtacctcgtccggcgtatttccgtgtacctggttccagtactgggaggaaaccaccggcatggaattgatcgtgaaatatttgttcagctgatcaaacgcggatgccgcgccgccgcgtctgcagctcaccactgctgcccccggctttccggcaaacacatttccctttccgtagaatgcgcggtcgagaaacgaggtgatggcaccggatgccgccgcataatgcaccggcgagccgaacacaaaaccgtccgccgtttttgctttctcaacaaattcattgaccggatcgtccacaaagcagcgtccgttcttaagacagacattgcagccgatgcagccggcgatcggctttgcacccacctgaaaaatctcggtctcaatgccgttcttctcgagagcccctgccacctcgcagagcgctgtataagtacatcccttttccctcggacttccgtttaccaatattactttcatgttctttcctccatcctggcagatttcctgccttctattctatgccactttccctgtgatcgtacgcttatgaaatataaagtgcttcctgccttgggtgggtcggaatcgctccattgatgttctccgtcttccctatgaagcaaagaaaagctgccgtatcatctgttccggtgcaaaaatatcctcaaactggaaatcctcctccaggaattccatattttcctcggaatgttctacttcctttgaatacagctttgccactgccacccggtcttccacggagaatgttcctccgttctccagaaaacgcagtgcatccatatcgcggatcatcagaatacccgccaccgcaaactgtgccttatttaaaatgttgtcatcataatacgatctcataaaataccggaatgtaaagtagaccagcagatgctcatactcatattcccttccctgctgcgctgcgtgaaagttcctgatacattccagataattgtcctcatggaatgctgcacgaagacgtttcttttcttcctcccagttctggtcgagcacttccagctgttcgtagcgctccatgcgtgcaagaaacgccgcatacgcctccccaggcgttacctctttctccctgcactcggcaatcagccggctctcacgctgctcttgctcctgcccgcttacttccccgcctgtgtggtatccgtaaagttcctgctgcatcctcttacaatatagaagatactccgccgcgcgctctgccaccggcttctcccggttctgaagcaatgccaccgccgccttagaaacggcattcagctgatcggcatccacagacacttcctcatcgtcgtcatacccctcaccgtcggaggtatcatcctcacacgctgcctcatcattaccgtacaatgccccgtcggcatcataagctgcctcggcgtcgtccccggtcccgcagaaatccggcatctcatgctcctgccaggtgatcttctcgtcggtggaaaacataatgtttccgacctcctcacatgccagacttaagatcttctcccggacgtcctcatactccatggtaaagcgtgggaactcggtgcagatctcgctcagtgcttcctcgcccatcttaatgcagatgtcgcagagctttttttcatttaaaaacgggcagtacccgtcctcgcgcataatcatggtgttctcctcaccctccctgatatgcgaggtaatctcttttcccagctctccgcccagactgcggtagtaatccatcgtaccctcatcgatgtcgatctcccagccatagcagcaattatccttgcactgatctgcaatacagtgaaacttttcatagtaagacggtacttttaatatcatcgtttgctcctgtctgcgcctcttcctgcgccattttatatccatttacggtgcaaaaaggtgcgtcatccgccgcacctttttgtaatcctactcatctttccggaaatgatcgctcaacatatagccgatacaccagacgcctcccgccagtgagagatacacaaacccctgcaccagtgcgaccgccagcttgatcagagacaaatctcctgccatatgcgccagaatcactcctctgaccggtcctcttaagatcatccatcctcctacatagaaccagccaacaacccccagcgtgtaaaaaaacaacgccagcaatgccttccatgttattttcatatctaattctcccttgttgatcctgcaataccgcgtttattgtaacacaaaccgcaggaagatgcaaaatccttccctcttctacatcagctcccggatctctcccgaccggcaatactctgcacagtcgatcacccgctggttggaagaccccttaaacagcagggatatatcatgaagctccgtcacaaacggtccgtccaccagcacatcgatcatgtgaagcagctccgcggtatctgcggtacagcattttccgcccggcacaagatcccggtctaacacatagccggtgtaggcccacacatccttccccggacactccgccttcactctccgcataaacggaagcagcgccttctgattctccggttcaaaaggatctcctccgagcagcgtcagtccccggatgtaatccggcttcaaggacgcaatgatctcatcttccacctctccggtgaaaggattcccgtattcaaaagcccacgtctccggctgaaaacagtctttgcagtgatttctgcagcccgacacaaagagaacggtgcgcacaccggttccgtttgcaatatcacaatatttgattgccgaataattcatatcttttctcctcaacagggaaagaaagactgtggctgcacaatcccgtgcacaccacagtccccctgtttttataaatgtaatacccgttccttgatctcctgtgttctgccctgattccagaactgcgttccaatatagccgcaggtacgtcttgccacgctcatcttgttctgatcgcggttgccgcagttcgggcactcccataccagcttgccgtcccggtctgtcacaatcttgatctctccggcatatccgcactccatgcagtagtcactctttgtattgagttccgcatacatgatattttcatagatgtactgcatcacggaaagtaccgcttccagattgttctgcatattcggaacctccacgtagctgattgctccgcccggggacagttcctggaactgtgactcgaactttaacttatcgaacgcgttgatctgctctgtcacatgtacatgatagctgtttgtgatgtagttcttgtccgtcacacccgggataatgccgaaacgcttctgtaagcattttgcaaacttgtaagtcgtcgactcaagcggggttccgtagagactgaaatcaatgtccgtctccttcttccacttggcgcatgcatcattcagacgacgcatcactgcaagcgcgaattccgtgccttccggctccgtgtgggatacgcccttcatatagcgtgtgcactcgcagagtcccgcatagccgagagaaatcgtcgagtaaccgtgatagagaagttcatcgatcgtctcgcctttcttcagacgtgcaagcgcaccgttctgccagagaatcggcgccacgtcggaaggtgttccctttaagcggttgtggcggatcatcaatgcctgatagcacatttccagacgctcatccatgatctcccagaacttcttctcatctcctccggaagagcatgccgcatccaccaaattcaatgtcactacgccctggttaaagcgtccgtaatacttgtgctttccttctttataattcttggcatgtgccagattgcccgtcgtgcggtctaccgtcaggaaagaacggcatcccatacaggtatagcagtcgccgtcttttaactttttcatcatcttctcagagatataatccggcaccatgcgctttgcggtacattcagccgcaagcctggtcaggtaccagtatttggacccctccctgatattgtcctcctcaagcacatagatcagtttcgggaacgccggcgtaatataaacgccctgctcattcttgacccctaaaatcctctgatgaagcatctcctcgatcactgctgccagatcgtcccgaagctgtccctccggcacctcatccagatacataaacaccgtgataaacggagcctgcccgttggtcgtcatcagcgtgatgacctggtactggatcatctgcacaccgcggttaatctcctctttgacccgcatttccgccatctggttgactttctcttccgtcgcctcgattccggcagtctcaagctccttgcgcacctgcttgcggaacttctcacggctcacctgcacaaacggagccagatgagaaagggaaatactctgtccgccgtactgggagcttgcgatctgcgcgattgcctgtgtggcaatattgcaggcagtagaaaagctcttcggcgtatcgatcatcgtctcgctgatgaccgtaccgttctgaagcatgtcctccagattgaccagacagcagttatgcatgtgctgtgcaaaataatccgcgtcatggaaatggatgattcctttctcatgcgcctctacaatctccggcggaagcaggaatcttctggtgatatccttgctgacctcaccggccatataatctctttgtacgctgtttacagtcggattcttgttggagttctcctgttttacttcctcgttattgcattccagcagacttaaaatctgctcatcggtagagttggacttgcgcaccagttctctcttataacgataagtaatatagttgcgggcaacattaaacgctttctgactcatgatctggttctccaccatatcctgaatctcctccacactcggggagcgcttcatattctcgcaggctttctcaacattggaaagaatcgcctgaatcttgtcgtctccaagcttttcataatcaatgacgctgtcgtttgccttgcggattgcagcctcgatcttgctgatgtcaaaaatgtcctcgctgccacttctcttaataatcttcataaccgttcagaatcctttctgttaattgctttttcattatacaatatctagtattgttgtcaatgcgttttcctagattctgtggttattttaccttttgaacaaaattaacaccaaaacttcgtcactttttattgttttggtttacaacaacatcttgtgtcttctgctattgtcacatccagattttgtagcatctgatccaggcagcgcttcaggtgctccacatcctcctccgaaagccccgccgtcaggcgcgcttccatctcccgtatatcgcgctccgcgccatccaaaagcgcagcggccttatctgtgagcaccagacgttttaagcgcgcgtcgtgtgagacctgggcgcgctcgatcagcccctttcgttccatcacggcaagcatattggacgccgtagctctcgagaccgagaacgcctcctcaatgtccctctgatagacctcccggtctgcgtgatcctttaaaaagccgagcgtccagcgctgcattcccgtcagattgtcctcgttttcctcccgttttgcttccatattcttatggagctggttgtggagcaggcgtattttgtatccgatggtctccgaccttttgattcgttccatctcttcctctcttctgtctgttttctaaaataatcattgacttctgtttttaattatcgtataacattattgttagcacactaacaattaaaaatcaacagaaaattcaaaaaggatgtgaaattatgttaaaaacacttggagcacagatcagggagttcaaaaaagattccctgcttactcccgtcttcatgattctggaagtcttcatggaaacaatcattcctctgatgatggcttccattatcgatcagggtgtggaagcgggcaacatccaccatatctacgtcatgggtgcctggatggttgtcgccgcctgtttctccctcttctgcggtgtcatgggcggaaaatacggtgcaagagcctccgcaggttttgcacgtaacttaagaaaagcgatgtacgagaacatccagagtttttcgttttccaacatcgacaaattcagtaccgcaggtcttgtcacccgtctgaccacagatgtgaccaacctgcagaatgcctaccagatgctgctgcgcatgtgtgtgcgtgcgccgatcagtctgatctgcgcgatgtgcatggcgtttttcatcagcccgagactggcgagcatctatcttgttgccgtcatcattctgggcatcattctcgccatcatcaccgtgcgcgcgcatcactattttatggaagtttttccaaagtacgatgacctaaatgcctccgtgcaggaaaacgtatccgccatccgcgtggtcaaggcttatgtgcgtgaagattacgagaaaaacaagttccgcaaagccagccagaatatttacaacatgtttgtcaaggcggaaagcattctggctttcaacaacccggtcatgcagatcaccgtttacagctgtattcttgcgatcagctgggtgggcgcaaaaatgattgtcggcggaacattgacaaccggagaactaatgagtcttcttacctattgtatgaatatcatgatgagcctgatgatgctgtccatggtgttcgtcatgctggccatgagtgtggcaagcgccgagcgtatctgtgaagtattaaatgagaagagtgacatcaccaatccggaaaatgcggataagaccgtgccggacggaagcatcacctttgaccatgtgaccttccgttacagcaggacatccgcaaagccagtgctctccgatattgacctctccataaaatccggcgagacgatcggtatcatcggcggaaccggaagttccaagtcctcgctcgtcaacctcatcagccgtctctacgatgtatccgaaggccgtgttctcgtcggcggaaaagacgtccgttcctacgatcttgacaccctccgcaacgaggtctctgtcgtattgcagaacaatgtgcttttctccggaaccatctatgagaatctccgctggggagatgaacatgcgaccgacgaagaatgccgtcacgcgtgcgaactggcatgtgccgacgaattcatcgagcgttttccggatggttacaacacctacatcgagcagggcggaaccaacgtctccggcggtcagaaacagcgtctgtgtattgcccgcgcgctcttaaagaagccgaagattctgattttagacgacagcaccagcgcggtggacaccgctaccgatgccaaaatccgtcgcgcttttctcacggagattccaaacacgaccaagctgattatcgcacagcggatctcctccgttcaggatgcagaccgcatcattgtgctggataacggagagttgaacggtttcggcacacacgaagaattattgcagaccaatgccatttaccgcgatgtctacgagtcacagaccggcggcggcggtgattttgatgaaggaggtgctgcctgatgccacagaatgaaaaaaatgcaaagccgatcggcggaccgggcggccgcggcggtcacggtcccagaccgaatgtcaagaatccgggaaagctttttatgcgcctgctttcctatattatgaaaaattatgccgtacactgcgtcattgtcgtgatctgtatttttatcacggttctcgcaagtgtgcagggaacctggttcatgcagaccttaatcgacggctatatcctgccgctgatgaagcagagcgatccggacttttctggtctcgcacacgccattttacgcgttgccgtcttctacggcatcggcgctatcgcagcctacatatacacaagaattatggtcaatgtctcacagggtactttaaagcatctgcgcgacgacatgttcacccacatggaagagcttcccatccggtattttgacacacactcccatggagacattatgtcaacttataccaacgatattgataccctgcgccagatgatcagccagagtatgccgcagtttttgaacagcatcatctccatcgtgagcgtctttatcagtatgcttcttctcaacattccgctgacgctcgtcacacttgtaatggtcggtgtcacactgtttgccacaaagaagatcggtgccttaagtgcccgctactttatcgcacagcagaaagatattgcgacggtcaacggctacattgaagagatgatgaacggtcagaaggtggtcaaggtcttcacccatgaagaggaaagtatcgccgatttcaaccggctcaatgaccagctgttccacagtgcagacaatgccaataagttcggtaacattttaatgccggtcaatgcacagatcggtaatatcagctacgtgctctgcgcgatcgtcggcggtattcttgctctgggcggatatggcggatttacgctcggaaagctcgcaagttttcttacctataataagagcttcgggcagccgatcaaccagctctccatgcagcttaacaatatcgtgatggcactcgccggatcagagcgtatcttcgctctgctcgatgagcagccggaagtggacgacggctacgtcacacttgtccgcgccagacaggagaacggacagattgtggaatccaaagagcgtacgggtatgtgggcatggaagcacacccatcaggcagacggcagtatcgattatattgaattaaagggcgacgtggtatttgatgatgtcgatttcggctatgttccagagaagaccgttcttcacaacgtagatctctacgctacgccgggtcagaaaattgcctttgtcggcagcaccggcgccggaaagacgaccatcaccaacctgatcaaccgtttctacgatatccaggacggcaagatccgctatgacggcatcaatatcaacaagatcaaaaaagatgacctgcgccactctctcggaatcgtgctgcaggacacccatcttttcacggctacggttatggaaaatatccgttacggcaagctggatgccacagatgaggaagtcatggcagctgccagactcgccaacgcagatacatttatccagcagcttccgaacggctatgacaccctgctgaccggcgatggtgccaacctaagccagggacagcgtcagctgcttgccatcgcaagagctgccatcgccgatccgccggttctgattctggacgaagcgacaagttccatcgatacccgcaccgaaaagattgtgcaggacggtatggataagctgatggcgggacgcaccacgttcgtgatcgcgcaccgtctctcgaccgtgcgcaacagtgactgcatcattgtcctggaacagggacgcgtcatcgagcgcggcagccacgatcagctgattgaaaaacacggcaaatactatcagctgtataccgggaatttagcggaaggctaaattcccgtgtaattccagcggaagatgaaactcccaaaaaaatagaactgtcgcactaagcatagcgtgctttgctctgataagtaatattattagaggaccacaccgtgggatttcagatggaaatgcagccggaaattcggttcaaaaaatgtggaatttctaaccaaccgaatgtttgcatcttcgatgatccgtgtctttccaagtttggagcactccgcgggtcatgtccgcatcccggagacaatttgtaggacttttgtgtgtgtcccttattggcacctctgaacaaaacataaccgcgcgaagccgatgtctgaattgccatctgccatgtttttaatagcagatggcaacgagtttcggttcgcgcggttttatatcgtctgtgaagaggtgccattagggacaccagaaagtccgcccattgtctccggtgtgtcggacatgcacccgtcggattatccaaacgtggaagagacacggaatccgatgcaaacattcagccggaagaaattctcacatttttctcaaacgaatttccatctgcatttccacatgaaatcccgaagtgcgtttctcataatattacttatcacccaaaaaaggtctatgcttattgcggcaatctattttatgagggattcctaatctcctcaaacttctcccaaaatccttcgacagtctccccgccggagcagatcttatccgccagtgtcacgatccatgcctccctgcagcacggcggaatcggattgagcggaaacatatgccgacggatcgtctccttctcaatctcactcagttcaaaatcttccatcgcattctgcagcgcttttcctgcatgataaaatccatgccacttatgggaatcgtccttctcatgccagtcgtacagaaaatagtcatgcagtaacgccccgcggatcagcgcatggcagttcacgcggattctatacttttccgcaatgtaaaaactgacgtacgccaccgccacgctgtggcggaatacgctcgtggaaccatgctgcataaaccggctggaggagagaaacctggaatttttgcatacctccgtaagaatctcccgaaaaactttctcattctcttttgacaaatgaatccgcttcttttttctgtccatttcccttaaacacttcctctgtcagatctgataaccaccggatctcattcggctgcatggcaagatcaaaaccacctctgtttcaagtcctacctgtccacttcgattgtgattacaattccatctcccgcatcttcctgaatcgcttcctgcacaccctgaatcacatcttcctgcagcgcatccttgttagtagaagattttgcatacattttgatctccggattaccgagacttctcacatcatcccacgtaaattcagccagattgatcccggtcgggttattcaaaatctccaggtcatccatatcacagtagagttccattccatgcagcgtgcacactgctccaaaattctgggagtctccgttttcatcctcatacttatacgttgttgtcgtgctgcgtatcagacgctcgatctcatagataatctgcccccatacctgtgatgccatccagtcgtcatcctcgtatgttccgtttgcgaccagatacgtgctgatataccaggagtgggaattgttatatccgtaatcaatgctgtaataatcataggtgtcgtatacgtatccgtctaaagtaggatgattattgctggtataatagtgttttccgtttaccttatcttccttctcggtccttgtgatctcatacccgtccggcaaaaacgatttcagaacgtcgccgtatttccgctccagatgatagcttttatgatatccgcagccgccaataaggctgactgctgtcagacatgccagtgccactctgtatttgcagtgcaaaaaatgttttttctctctgcttaactgcatcattttctcttcctgtcctatacgttattgtctaatatacttcggcttattttaacatatctaattacaaacgtgcaagtataacgcacaaaaagaatcgcagtccatggaaacatgaactgcgatccttctatgcattacacaatctgctgatcggactgattatttgtacagctctaccagtctctgtaagtgctcgtaacgagcctttgcagcttcctcggaagccttgaacagtctttctgctctctccgggaatgctctggtcagacggctgtaacgtgtctcgttgttcaggaaatcctgataagaaccgtcgcccggcttggatgtcagagtgaacggattcttgccctctgccttgagctgcggattgaaggagaagaggttccagtaacctgctgctactgctttcttcatctcatcctggcagtggttcataccaccctttacaccgtgcagctcacatggagcgtaaccgatgatcagagacggtccgttgtaagcctcagcctcagcgataaccttgacagcctgagccatgtttgcaccgagagcgatctgtgctacatatacataaccgtagctcatagcgatctctgcaaggctcttcttgccaacttccttaccagaagctgcgaactggcaaacctcaccgatgttggaagccttggaagcctgaccacctgtattggagtacatctcggtatcgaataccataacgtttacgttctcaccggaagcaagtacgtgatccagaccgccgaatccgatatcgtatgcccaaccgtcaccaccgaagatccatacggacttcttagcgaggtaatctttcttctcaactgcagcctttgcatccgggcatccggctgctgctgccttctctaactctgctacaagagctgctgctgcaggagtatttgcctttgtatcgttctttgtctcaacgaacttgtcaaatgctgcctttaactcagcgcttgccttgtcagatgttgcgcacttctctgcagaagcgattgcctgctcacgaagtaccttctgaccgatttccataccaagaccatgctcagcgttatcctcgaataaggagtttgcccatgccggtcccttcttggaatctttgtttaccgtatatggtgatgtagctgccggaccaccccagatagaggaacatccggttgcgttactgatgtacatatgctcaccgaacagctgtgtgatcagacgagcgtaagatgtctcagcacatcctgcacaggaaccagagaactcaagcagcggctggttgaactgggatccctttacagtgttgtctgccggcatgccaggcttcttgcctacgtttgctaccaggtaatcgaataccggctgctcttctgcctgagactcctgcggaaccatctcgattgcgcctaccgggcagacagtgatacactcaccgcatcccatacagtctaacggagatacgctcatggtgtacttgtactcgcttgccttcggctttgtatctgcaagcttgatgttggaaggagctgccttcacctcatcctcgctcagcatgaacggacgaatggttgcatgagaacatacaaatgcacactggttacactggatacacttctcagcattccatgtcggaacggttacggctgtaccacgcttctcatatgcagcagcgccaagctcgaactgtccgtccgggttctccttgaatgcggataccggaagggaatcgccatccattaaggagatcggctccattaagtctcttaccatcttaacagtcttcggaagacccttaagctctgcaggagctgcgtctgcctccggattcttccaggaagccggaacctctaccttatgtactgcgtctacaccggcatcaattgccttgtagttcatctctacaactgcgtcgcccttcttaccgtaggacttcttagctgcagctttcatgaactctactgcctgatcgatcggcataacgtttgcaagtttgaagaatgcagactgtaagatcgtgttggtacgcttgcccataccaatctcgattgccttgtcgattgcgttgattgtatataactgaatgttgttctctgcgatgtacttcttcgcatctgcattcagatgatgagctaactcttcatcagaccactggcagttgatcatgaatactccgcccggcttaacgtcctgaaccatcttgaatcccttggttacataagacgggttatgacatgcaacgaagtctgcctggttgatgtagtacgggcttctgattggcttgtcaccgaatcttaagtgggaaatggtaacaccaccggtcttcttggagtcatactggaagtatgcctggatgtacttgtctgtgtggtcaccgatgatcttggtggagttcttgttcgcaccaacagtaccatcaccgccgagaccccagaacttacactctacagtaccttctgcagatgtgatcggagccggcttaacctctggtaagcttaagttcgtaacatcatctacgataccgattgtgaaacgagccttcggagcatctttctccagctctttgtatacagcgaatacacttgaaggaggtgtatccttggaacctaatccgtaacgtccgcctgtcaggacaacagtgtcgagaccagcctcacggagtgtggttgcaacatcaaggtataacggatcaccaagtgcacccggctcctttgttctgtcaagaacagcaaccttcttagctgtcttaggaagagcctttaaaaatgcctctgatacccacggacgatacagacgaacctttacaagtccgaccttctcacccttagcggttaagtagtcgattacctcttcagctacgtcgttgatggaacccatagctacgataacgcgctctgcgtccggtgctccgtagtagttgaacagatcatagtttgtgccaagcttctcgttgactttcttcatgtacttctcaacgattgccgggagttcattgtaagctgtgttgcaagcctcacgatgctggaagaaaacatctccgttctcgtgggaaccacgcatagccggatgctccggattcagtgcatgtgcacggaactctgcaactgcatccatgttgcacatctctttgagatctgcataatcccacttctcgatcttctggatctcatgggaagtacggaatccgtcgaagaagttgatgaacggaaccttaccctcgattgtagcaagatgagctaccgggcttaagtccataacttcctgcgggttggtctcgcacagcatagcgaaaccggtctgacgacaggcgtaaacatcgctgtgatcaccaaaaatatttaaagactgggtagctacggtacgcgcggatacgtcgaatacacaaggaagctgctcgcctgcgattttgtacatgttcgggatcataagtaacagaccctgagatgctgtaaaggttgtggtcagcgcacctgctgcaagggaaccgtgtacggcacctgctgcacctgcctcagactccatctctacgactttgacctgattgccaaaaatattctcctgtcctgctgcagaccactgatctacggtatctgccatcgggctggaaggtgtaattgggtaaatagctgcaacatctgtaaacgcataagctacgtgagctgccgctgtattaccgtccattgactgttttgctctggacattattattcctccttaaattaaaatagagtgtcatattccgacttaagactaattttagcatttaatttgtcgattgtaaaggtttcagactgtacgaaaacgtgtgcaatctacatttgtcatgttctgtttgtccctggtcagatatactttttttcaaactcctccaggggcagcgggcggtcaaaataatagccctgaccgtagttaaaaccgcactccatcaaaaacgtccgctgctgctcctcctcgattccctcaaaaatcacctcctcctttgccgactggatgaactgccccatctgatagacaaaagcactctgtccgttctggtggattttgtcggtaaagctcttgtcgatcttcactacattcgccgggatttccaacagcacgctcagcgacgagtagccggttccaaaatcatcgatggcgatgcggtagccgagtttgccaagtctggtaagacacgcctttaagctgtctaacttctccacaatcacactctccgtcacctcgatctctatgtagcacggatcaatcccgtaccgctgcagggtattctgcaggcgttcgataaaatcgtcgccgccgttctcaaaatttctcctggaaaaattggtggagatcgtaaacagttctcttccggaatccctccagcggcgcattgcccgaagcagctgttccagaatataaaaatccagatccacgatatagcctatattttccagtgcagggataaaccgtgcgggagacagaatctcgccggattccagacgccagcgtgcaagcgcctcggcgccgtagacccgctcctcgcggagcaggaacttcggctgtaaatatacctcgaactcgccccgctgcagtgccgcgtaaaatcttccggtaatccggattccctcatcacgttttttcctcatgtcatcccggtaaacgaccgctcccacattctgctccttggcaagctttcgtgccagattggctccctccagtatcttctcaaacgtctcttccccgtcatcgataaagcagattccagccgaaagctgcatggctcccgccggatagcggatctttaactgttcgccaaacatctgatcctctctctccacaagccccagaatgttctttttgtccgttcctctgaccaactcaatgaaataatccgaatacattctacaggcctccacgacatgggactcgctgcggattaacgctgcaagctcctgcagaatactgtcgccggcctcctgtccataattttcatttacataggcaaagttgttcacgtccagatttaccagcgcgtacaccatgttctcatcctgcgcaagcccaccgctctttaattttttccggatcagcctgcggaatgtgtccagattatacagttccgtcagcatatcctgattctgcagatgccgtatctctgcctggtcatcgctctgcctgctgcgaagggagacaaatacagcaaccacccgcgcgagttcactgagcatccctgcttcctctttggaaaatccctctgcactgctgcttcccacacacaggcagccacttctgttaccggaaaattcaaactttacatttccacagtttttgatggaagttccatgatatttctccgcccccaactggggaacctccgttaatatatcttccgttggcgtcgagacaaaacgcccgatttccgcctcccggaacactgtaaccgattgtgggaatacctgttgttccacccggctgccatcccggttccagtaattcatcaacaccatttcctgctgttcttcccggtactcaaacaccatggcaaagcccagcccgtattttttcccaatctgttcgatcagcacgttcaaagatccgttgatatctttcgcatgcgagagaaggctgaacgcaaaattcaggaactctttatccaccttctgcccgctttccggagcatattcaatcctgtcgcgcctgcgctcccgctctgctccctcttgctgctttttgcccgcaaacgaatagtggtcttttccttcccgcttcgtggcatacatcgcccggtcagccatcgcaaacagggtctcataatctcttccatcctcgccgtatactgccatgccgatgctgagcgtcacctcaacgatggcgtcgtcgccgatcagcttttttctggcttcccggcccagcgccgcggcgcacgcttctgcctcctttggagccacatcccgcatcagcgccagaaattcatctcctccgactcttgcggtgacatctgtctcctgaaactggctttgcagcacgccggcaatatcagtaattaccgtatctccgacggtatgcccgaatgtatcgttgatccgcttaaaattatcaatatcgatcaggaacagcacatgctgtttttccggctcactttttaaaatccgttctacctctccggatgccgccaccttattataaagccttgtcagcgggtcgcgcttcgcctcctccgacagttcctcctgaatcctgcggtcggagctgacatcgtagctgcgtccgatgatgcggataatctgtccgttgtccccgacaatgctccggtaaatcgtccggtaccacacatatacaggttcctccccggcagccgccacattcatccggtaatcaatacttcctgtccgcacatccctgctggctgcctccagcaccctggcatacgcggcacgatcctcctcgcagatatccgcgagcatctcctcataatccatatatctgcgccctgccgttcccggctgcccgttcccgcgatatttgcgcggcaccctgaaacgccgctgtgcaacgtcgtactctagcgggaattcatcggtgacctcttctaacatgctgtactgctcctccatcaggcgcagttcttcctccagattcttccgcttgtctatgttccagcttgccaggatatagtaaggtaccgcgtcccggtaataatacagtctgcaccgcatcagttcccagcagacgccgccgctcttcgtacggatgcgcagttcaatctcctccgtggttcttagttcccggcacacttcgatggcatcctcgaacacaccggtatcgtcccggtacaaatactccacaaacggcgtatttccggtcagttcctccctgtcatacccctctgcatgcaaaaattcccggttcaccatctcaatatacagctcattcccgccgcggactaccgctattccgaccggcatcttgccgatcagatcttttctctgcccccgctccatgtctattgtatttatttgcgtatccccatactccataaaatcaatctcctgagatgcaatttcctctgtcatacttaagataactccgattgccttcccgtacattatatcaaatttttaacgaaatccaaacaatttgtcacagcgtgaaagccctttttaataagaagttccggttgcatttctccgtattttttagtatgatacgaattggtgcaataaaagcaggtgatttacaagaaaagttaggagaacataaatatgatcagtacaagcaacatcactttacgaatcggaaaaaaagctctctttgaagatgtcaacatcaaattcacagagggctgctgctacggtctgatcggtgcaaacggcgccggaaaatctacgttcctcaagattctgtccggccagcttgaaccgacgagcggagaagtcatcatcacgccgggtcagcgtctttcctttttgcagcaggatcattttaaatatgacgagtacacggtactcgataccgttatcatgggcaacaagcgtctctacgatatcatgaaggaaaaagacgcgatctacatgaaagaggatttcacggacgaggacggtatccgcgccagtgagcttgaagccgagttcgcagatatggacggctggaatgctgaatccgatgcagccaccatgttaaacggtcttggcatcccgacggaggatcactacacgctcatggcggatatgccaagtgccttaaaggtcaaggttctccttgcacaggcgctcttcggcaacccggacattcttcttttggatgagccgaccaaccatctggatctcgatgcgatcagctggttagaagaattcttaatcaactttgagaacacggtcatcgttgtttcccacgaccgctacttcttaaacaaagtctgcacaaacattgcagatatcgactacggaaagatccagctctacgccggcaactatgatttctggtatgagtccagccagcttctcgtaaagcagatgaaggaagccaacaagaaaaaagaggagaagatcaaggagctgcaggaattcatctcccgtttctccgcgaatgcttccaaatccaagcaggcgacttccagaaagcgtgccctggaaaagattcagctcgacgaaatccgtccgtccagccgtaaatacccgtatatcgatttccgtccgaaccgtgagatcggcaatgaagttctgaccgtcgaaggcattaccaagaccatcgacggcgtcaaggtgctcgacaatgtctcctttatcgtcggacatgacgacaagatcgcgtttgtcggaagcaacgagctggcaaagacaacgctctttaagattcttgccggtgagatggagccggattccggcacctacaagtggggcgtgacgaccagccagtcctacttcccgaaggataacaccgagatctttgataccgatcttctgatcgttgactggctgacacagttctccgagatcaaggatgcaacctatgtccgcggtttcctcggacgtatgctgttcgccggagatgacggtaccaagaaaatgcgtgtcctctccggtggagaaaaagtacgtgtcctgctttcccgcatgatgattatgggaagcaacgtgctgatcttagatgaaccgaccgaccatctggatatggagtccatcaccgcattaaacaacggactcatcaagttcccgggcgttattctttttgcctcccgtgaccatcaggttgtccagaccacagcgaaccgtatcatcgagttcctgccggacggcacctttgtcgacaaggtatccacctacgacgaatacctcgagaatgatgagatggcaagaaaacgtcaggtatactccatgtcatcggatgacgagggcgataactaagacccggtcttttttacaaaatcacacgggagcgctgtgtcaggaaaaatctccggcatagcgctcccgttttctgttcttctaaattctgttttcactcccgccgattccgcgatcctgttctccggcgcccctacgcttccttaggcttccggtactctgcctcccgcataccgagcgcaaacgctcccataatacccggattttctccaagtgccggcggcacgaggtaggtatcgatctcctttaagattttctcattggaaatatacccgcccagcagttcctgcactttcgtgcgcaccattgaaaagagctggctctggtgcataattccgccccacagcacaatcttctgcggagaatacgtcagaacataatttgcaaccgcctccgcgagatagaacgcctccatctcccagacatcctcccggtccgccagttcctttgccggtctgccccagcgcgcctccaccgccggaccgcttgcaagcccttccagacagttggcatggtacgggcattttccggcgtaggtgtctttcgggtgacgctgcagaagaagatgtcctgcctccgggtgcaccagcccgtgcatgagcgccccgttacagtagacgcccacgccaacgccggtgccgacggtaatatagattgccgtgtcgcagtcttttgcggctccccaggtaacttcgccaagcaccgccgcattcacgtccgtatcaaatccgaccgggacgccgagcgcccgtgtaaaagttcccaccatatcgacattctgccattccagcttcggcgtgctggtaatatatccataggtcggggacgcacggtgcagatccaccggtccgaaacacccgattccgagtgacgagattccttttccctcaaaaaacgcagccatgcgcggcagggtaatcttgggcttctctgtgggaatcgtcacacgctctgtgattgtgacctgattttctcccggctgtcctttgtctgtctgcacttccccgatcgcgcacaccatcttggtgccgcccgcttctattccaccaatccgcatccttctcttcctcccttttcttatatataccacttcggagttctctccgccagtcatatttcaaagaaccggaatatttaagagacagcagccctcccggatgaattagaaaattctccgcaccgccagcacgctgcggtaggttaccggagaagtcagcgtaatgcctgtcttttcattgctcgcatgaatcagtgtgttattgcccgcatagatgccgacgtggccgctatagcagacaatgtcgcccggctggatttccgacaggctgacggcatatcccacactccgctgttccgacgatgtgcgcggcagattgattccaaatgccgcatacacgcccttgacaaatccggagcagtcggttccgtttgtcaggctgttgccgccgtatacataagggtttcccagaaactgtctcgcgtaatcgaccaccgcctgaccgttggaggaagccgtctgcgcactttgccccgcactgcttccggaaccgcttcccgcgctgcctccggaactgcttcccgcgctgcttccggaactgcttcccgcactgctgcccgcgccggattttttcacctcctgtttttctgccgctttgcgggctgcttcctgttctgctgccgcacgtgccgcctccgcctctctggctttgcgcgcttcctccgccgcacgggctgccgcctgccgttctgcttcctctctggcaagccgcgcctcttcctccgcttttgactctgcatgaatgtactctgtggacagcgtcacataatccagtgccacataaccgtcaccgtccgcggtggacactttcgcccagccttccgtcgactcgtcggttaccacaacgtcatcgccgtccggcagcatggtaagcaccttcgcctcggttgtcggctccgtccgcacgaacagggtcgtcgttgtgacggtcgccaggcgcgttcccacacttctggcaagctcctcatcccccacgaccacatattccgccttgacatatccgttcacatttccggacgtaatccggtaccacccgtcctccgtcgtctccagcacagtggctgcggatttgtcgtaaagttttccaagaatttcactctccgtatccggttcctgccgcacgttgacatagtgattcacctgcgccactgcaatatccgcaaactctgacgcggtctgcggaagttcattttccgcaatctccgccgtctcccacgcttcctctgccaccatctccggttccatcatccgcgccacagccgcgttactttgcagttcctccacaacatccgccgtctgcgcctgcactcctcccgcttccttaagcacctgtgccagcgtctgtgtcacgcccgccaccggcacctcacgtttttcctgtcctgcctgcaccattccatagcttcccagtgtgacggctcccgccagcagaagcgccagtattgtcattcttttcttcattatgtagaatcctcccgatttattccatatgcttccatattgttacttatttgttacaaaaatatttcatttctgcaacaaccgtattgtaacaaaggaaccacatggaatctacagggaactctttccatttttcgctctcttttgtccggtctgccgctttgtcccgcaacgcaaaaggaacccaaaggttctttcgtccctgcgggttcccttcgtattttccttccggtttaacctaaacttccttactaatagcagaagctgtgtccgccgatcttttggtccagtctcggcgtcaacggttccgtagaaaaatataacgtatcatttcttaatatatgtgtatttccattcaatacctcatgaatcgaagtgtattccttctccgtggggtttgcccgctctctgttcttccaggaacagaactgcgtcgggtttccctgactgagcacgtcatacaaggtatctggatatttttcggaagccatccggttaaaaactacctcgaccacggcttcctgcccttctgtcggctcgccctgcgattccagccagacgatttttgccaacaaatctatctcctcctgcgtcaatgtgatattccagcggttctctgcaccggccgtcgtctctgccgtcgcaggcttgctctctgccgcctccggcgcctctgcttcctccgatgctgcctgtactttggcttccggcgtctctgctttctccgatgctgcctgtacttcttgtgccgcatcggacggtgccgcacttgctaccattgttctggggttctttgtgattcctgtcgcttcatctgattctgtcgtaaatgaatatccggataaaacacggcacacacccgcaaccggaacctcagttccgtctgccgcagaaattacatacgcgctgctgatctcttctctgctctcccgtatcgtgttcttctcctcaatgttggccgcaaccataagacaaatgcataaagtgcacagcattgtcacgtccaatatttttctgttcattttgctcctttcctcaagaatgatactctgtgagctgctctcgcactcgttgtttcatcatactagattcttcccaaaagtcaaatttcccattcacaaaattccagaaaatttttctttacattttcccagaaatgcggcaaaagcgtgttctgtcgtatccaatacttccgaggaatgctttgatgtgttaaaatagaactgctcaaactcacaaaaaaaacatcccgaaacgggatgttttctatattccttccaatattcctgcgcggtttctgctgtcgcaaatcccgccatttttgtaccttttccggcacaatcttcctcggctaccgtgtgagaaacagttcttcaaacaccgggattttgtgttccggatccgcctgaaagatcgcaacatgcgcatcgtctgtgctcctgtcggcaaatgccggatataaaaacccgcagaccggccgccccggctcgtactctcccaccaacggagcgactgcaccgatcagatattcatatacctcctccgactccccctgccgctccttgtccgatgcctttaccggcacatcatagcggtcgtgaaagaccagaatcgcatacggctccctgctacggtaccgggcacccacaagctcataaaacgtgtacagcagcgcatcatttttcagtccgcactcgcgcattccgtacaacaactggcgcattttcctctgttctgcgccatccccgaatgcgtagctgcgcaggtttacattggttgctgcaaacggaaccgctttggcaatcgccagatttttctccttttccgccgcagacagattgagaaagttcacattaaaactctcatcgatctctccgtccggctccatatagccgcctgccacacgcgtaaaggaagtacggctgggcgtcattctgcgtgtcagctccagcatatcttctctgtttatcataatttctcccgtcccgtgtttttatgataacatttcattgccggcacatccatgcttgtcttcaccacacttatgttccgcgcaggaatgctcatgctcatgatgagaacatctcacatcgggattgtaatctaattttcctgcaagataagcttctaccgcttcatctgccgcaccggacactccaccatacagctttatgccggcagttgcaagtgcgctttgcgcaccgcctccgattccgccacagatcagcacatccgcacccgcctccgtcaaaaatccggcaagtgccccgtgtccctgtccatttgtgtcgacaatctgggatcttaccacctggctattctcaatatcatataatttaaactgttccgtgtgtccaaagtgctgaaatatttctccattttcataggtaactgcaattctcatccgatctgtttcctttctttgaatatcatcttttccgacggacgttgaggtgcgcctgcatattttattgcaacaaaacagggccgttccatcacacaatcgataattcccgcctgaaatctccagtgtctttccgtttacgatgctgtccgccattttatatctggctgactcataaatttcggtcactgttgtgcgggcaatccccatctgcttcgcacattgttcgtgcgtacacttctcaaggtctacaagacgaatcgtttcatactcatccatcgtcataatgactttttcccttgccggaacaccattcgggcaaaaattatcatatgccgcttccatacagattcttcttgcttttgtcggtcgtgccatcttttctcctcatgcctatttccgtcatatgtcaaaaactattataccgcaattttccttttttcacaactccctatgaaaattgatatactgaccgtctgccgccatcacaatgcgatcccgtttacaatctgtaagaatatgtaaaacgcccgtattgtgatcccgcctttgcatatactatcctgtaggaggtgagatcatgatcgcctggtttctttatctgatcttaactgtaaaaaaagattcttcggctcagaattgagccggctgtttcatcgtaggatacaaatagaaaaatataacgggaaaaagattcttacagaagggaaaagaaaggatatgatataacatgaaatgcagcacagcatgaaaaaaacaccgaatttacggtgtttttagagcaggggatgagagaatcgaactcccaccaaaggttttggagacccctatcataccatttgaccaatcccctatatttataaaaatgacgtatcagatacgtcatttattatcttactagatatctcacaaaaaatcaatggtatattgtaccttcaaaacttcatacagaaatcatccaacaaactttttggtcaagccctcgatcgattagtaacagtcagctccacacgttaccgtgcttccacctctgccctatctaccttgtagtcttcaagggatcttactcacttatgtgagggatatctcatcttgaggggggcttcacgcttagatgccttcagcgtttatcccttccggacttggctactctgccatgccgttggtcgacagcagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttatgccaccggatcactaagtcctagtttcctacctgctccacccgtcggtgtcgcagtcaagctcccttctgcctttgcactcttcaaatggtttccaaccattctgagggaacctttgagcgcctccgataccctttcggaggcgaccgccccagtcaaactccccgcctggcattgtcccaccgccggatcacggcggctggttagaaatccaatactgcaagggtggtatcccaacagcgactcccttgaaactggcgtcccaagttcttagtctcccacctatcctgtacatgcagtaccgaatcccagtaccaaactggagtaaagctccatggggtctttccgtcctggcgcgggtaaccagcatcttcactggtacttcaatttcaccggatgcattgtcgagacagtgctcaaatcattacgcctttcgtgcgggtcggaacttacccgacaaggaatttcgctaccttaggaccgttatagttacggccgccgtttactggggcttaaattcaaagcttcgcttgcgctaacctctcctcttaaccttccagcaccgggcaggcgtcagcccatatacttcacctttcggtttcgcatagacctgtgtttttgctaaacagttgcttgagcctattctctgcggcctgcgttagcaggcaccccttctcccgaagttacggggtcattttgccgagttccttaacaatgcttcttccgccggccttaggattctctcctcatccacctgtgtcggtttacggtacgggcacacatgaaacaatagcggcttttctcggcacatggctcacacgcttcgctactttaattcgctccacatcacgtcttcggattgcctggcggatttgccaaccagactccttctccgcttgtaccggtatttccattcccggctcgtgctctccacatgcgtccccacagttctgttcatatgtggtacaggaatctaaacctgttgtccatcggatacgtctttcgacctctccttaggccccgacttacccagagcagatcagctttactctggaaaccttggatattcggccgagaggattctcacctctctctcgctactcattccggcattctctcttcttatccctccactgctccttccggtacagcttcgtcggtcttaagaatgctcctctaccaatcactacgtgattccacagcttcggtgttgtgttttagccccggacattttcggcgcaggacctctcgactagtgagctgttacgcactctttgaatgtgtggctgcttctgagccaacatcctagttgtctttgaaatcccacatccttttccacttaacacacactttgggaccttagctggtggtctgggctctttcccttttgactgcccaacttatctcgtgcagtctgactcccattcatcatctacatggcattcggagtttgatattctttggtaagctttgacgcccccgcggaaattcagtgctctacctccataagactaaaatgaggctagccctaaagctatttcgaggagaaccagctatctccgggttcgattggaatttctcccctacccacacctcatcgccacccttttcaacggatgtgcgttcggtcctccattgccttttacggcaacttcaacctggacatgggtagatcacccggtttcgggtctacggatactgacttgacgccctattcagacttggtttcccttcggctccacaccttaagtgcttaaccttgccggtacccgtaactcgccggaccgttctacaaaaagtacgcggttgtgcatataaagcacttccacagcttgtaaacacagggtttcaggttctctttcactcccctcccggggtccttttcacctttccttcacagtactatgcgctatcggtcactaaggagtatttaggcttacggggtggtccccgctcattccatcaaggtttctcgtgtctcgatgtactctggattccgccatgtcatctttcctttcgcttacggggctttcaccctctctggcaggctttcccaaaacctttctgctaggattgacgaatcaattatgcggtccgaaccccggaatgcacgcattccggtttggcctctttccatttcgctcgccgctactttggaaatcgatgtttctttctcttcctccggctacttagatgtttcagttcaccgggttcccctccatacgttatggattggcgtatggatacatgaggtatgctcatgtgggtttccccattcagacatctacggatcaaaggatatttgctcctccccgtagcttttcgcagcttatcacgtctttcatcggctcttagtgccaaggcatccaccctgcgctcttttttgcttgacctcgtttacagtttctatagcgttagaaactgggtctttgcgtttaataacgcggatcgaattgcttcgatcttgaactttcgttcgtttgatttggtcgtaaactttgtttacgatattctcggatgtcttgataaaaaatcattttcatcaaaatcttctgtatgaagttttcaaggtacaatagcgaacttcgttcgcattagaaattgcttcgcaacttccgtcaaacggaatgttttgcaatttcaatggagatggtgagattcgaactcatgaccccctgcttgcaaggcaggtgctctcccaactgagctacacccccaattaaaatatgaaatattttaattttaatctggcagccacctgctttcccataccgtcgccagtatagtatcatcggccgcttaggtcttaaccatcgtgttcgggatgtggacgggtgtttcccctaagcgtatcgccaccagaaatatgaagttgtcattcgtatctgctcctttgtactcatgactcgctcgattccgctccgcttcatcttgctagagtcattcgtccaatctgtcttcgcttcaacaccggcttgcaaatgaatttgcaccgttgtctccgctcatccaggcagatactcattgataactaaacagtgaacaaactctctacttgatttccttagaaaggaggtgatccagccgcaccttccgatacggctaccttgttacgacttcaccccagttatcagtcctgccttcggcagctccctccttgcggttgggtcactgacttcgggcattaccaactcccatggtgtgacgggcggtgtgtacaagacccgggaacgtattcaccgcgacattctgattcgcgattactagcgattccagcttcgtgtagtcgagttgcagactacagtccgaactgagacgttatttttgagatttgctccccctcgcgggattgcttccctttgtttacgccattgtagcacgtgtgtagcccaagtcataaggggcatgatgatttgacgtcatccccaccttcctccaggttatccctggcagtctccctagagtgcccggccgaaccgctggctactaagaataggggttgcgctcgttgcgggacttaacccaacatctcacgacacgagctgacgacaaccatgcaccacctgtcaccactgctccgaagagaaagtacattacatacttgatcagtgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagcaatgctccccgacacctagtattcatcgtttacggcgtggactaccagggtatctaatcctgtttgctccccacgctttcgagcctcagcgtcagtaatcgtccagtaagccgccttcgccactggtgttcctcctaatatctacgcatttcaccgctacactaggaattccacttacccctccgacactctagtccgacagtttccaatgcagtaccggggttgagccccgggatttcacatcagacttgccgtaccgcctgcgctccctttacacccagtaaatccggataacgcttgcaccatacgtattaccgcggctgctggcacgtatttagccggtgcttcttagtcaggtaccgtcattcttcttccctgctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcgctttggtgggccgttaccccgccaactggctaatcagacgcgggtccatctcataccaccggagtttttcacactggatcatgcaatcctgtgcgcttatgcggtattagcagtcgtttccaactgttatccccctgtatgaggcaggttacccacgcgttactcacccgtccgccactcagtcacaaaaacttcattccgaagaaatcaattaaagtgcttcgttcgacttgcatgtgttaagcacgccgccagcgttcatcctgagccaggatcaaactctcatgttatagtttgtttccttttccagaataatctggcttattcagatgttactctgaatttactgttttaggttgttctttataagaacgttcgtctgtctttcaatctcttgatcgacagcttgaaatttaggatctttcaaggtttattcactgttcagttatcaatgtacatcgtcaatacttcgtattgactttagaagttgctccacaacttccgaacggatttttcaatctcattcatcgttgtcatctctcggcaacagcttatttactatatcataccatcaaccgtttgtcaacaactttttttattttcttttgcttctttttcagaagcgctttgcctgtccgctgttctcgcggtcagcttgtttatattatcatcattattttagaatgtcaaccacatttccgccgttttaaaaaagaaagttttcggttctgaattgttctaattgtgcatacaattcagaaccattcgtttttcttccacggactaccgcatcacataatccatcgcatccttaaccgtgcgcacgccgacaagaccgattcctttgatctcctttaagctctccctgcacacctccggcagaatacatgtcttaaatccaagcttcttcgcctcgagcacacgctgctctgccatgctgaccgcgcgcacctcaccgctgagtcccacctcgccgaagcagatggtcttctcgtcaatcgggcggtctttatagctggagacgatcgccagcacaagaccaagatcgatcgccggctcattcatccggatgccacctgcaatattgatataggcatcacaattccccagcgaaagtcccagacgtttttccagaaccgccatcagaagatttacccggttaaaatccgttcctgccgccgtccgcctcggcataccgaaattgctgtggcagaccaacgcctgtatttccagaaggatcggtctcgtcccttccatcgagcatgccacaacagacccggaggcgccctccggttttccgctcagcatgaattccgacgggttctccacctctgtcaggccatctccgcgcatctcaaaaacaccgatctcgttcgtcgacccaaaacggttcttcacacctcgcagaatacgatacgccgcatggcggtccccctcaaaatagagcaccgtatccaccatgtgttccaacacacgcgggccagccaccacgccttcctttgtcacatgtccgacgataaaaatggaaatcccaagtcccttggcgatctgcatcagggtgccggtcgattcccgcacctgtgagacgcttcccggcgcagacgagacgtcttcattatacatcgtctgaatggagtcaatcacgacgatctcgggcttctcccggtcaatcacgcgccgtatggtatcaagattggtctcacagagcaggcttaagctgtccccaaaggtcccgatgcgttctgcccggattttgatctgctgcaaggattcctcaccggaaatatagagcaccttcacctcatgttccgcaagattcctgcatacctgcaaaagcagcgtcgattttccgattcccggatctccgcccacaagcaccagagatccctgcacaatcccgccgccaagcacccggtcaagctccttcatgccggtggacacccgctgttcctgtgtcatctcgatctgtgacaggggaactgcctttgcctcacggctgccatccgtgctgcggttcccacgcgcggtctttttctcaaccgtctcctccacaaacgtattccactcatggcatgcgggacactgtcccatccattttgccgactcgtatccacattcctgacagaagtatactgttgtttttccttttgccatgttcttatcttcctttcccgcagacacgtctgctgcccggacagggctttttctccatagaaagcgcggctttcgccctttaacctaacacgtcatttcctattagagtaacaaagacctgtccatacggacaggtctcactgatcttgtaactgtcatatgcgaaagcggctgctctagcacttctggacgcttacctttaccggagcatcgccgagctctacgctcaggcttaactttcctccgagattcgtcttcatcctgccggcatctgcaccgtcgatcacgatgtcatactccgcctcatcctcaagctctacggtaacctgtgcgtcctctgcgccctctacgctaaactccattcctgtgtctgtcgcttttaaatgctccactgcagtccccggaacagactcgtatacaaacatgccattgcgctccagcttggtaatctcctgacaggtctttactttgtaaagatctccctggtgttcaaaattgtcaagctttgccttggtgctcaatgtgtaatccccaaagctgatcgttccatcctcctctgaacggagtaattcactaataacggccatcttatcctcctgtgatattgcagctccttcatccggtctgctttatcgtaaatttgtaaaaatattatataatatctgttctttgatttccagtgatttcactgacatttaagtaattttttactttttcttggactccagaaaaattgcatttttcttcgtcgtgacgatcacttcgtcaccccgccggatgcttccgtcgagaagtttttccgcaagcggatcctcaatctcatcctgaatcttgcgccgcagcggtctggctccatacttcgggtcatacgccttatccacaatgtactgctttgcggcatcgcgcacgacaagtgtaatgccaagttgtgtttcacagcgcttcgccagttcttttgtcatcagacctacgatctgtttcatgtcgtccttattcagcgccctgaatacaatggtctcgtcaatacggtttaggaattccggtttgaaaattctgcggacctcctccatcacgctgcccttcatccgctcatagttctgcttctcgtcattgccggaagcaaagccaagcttcttcggctccacaatcgcctgcgctcccgcgttggaggtcataatgatgatggtattcttaaagtccacttttcttccctgggaatctgtgatatgtccgtcgtcaagcacctgcagcagaatattaaacacatccggatgtgccttctctatctcgtcaaacagaatcacggcgtatggatttctccgcactttctcactcagctgtccgccgtcctcatgtccgacatatccaggcggcgaaccgatcattttcgacacgctgtgtttctccatgtactcagacatatcgatgcggatcattgcctgctcctgtccaaagacagcttccgccagtgccttggatatctcggtcttgccgacgccggtcggtcccagaaaaaggaacgagccgatcggacgcttgggatcttttaatccgacgcgtcctctccgcacggctttcgccacagctgataccgcttcctcctgtccgatcacgcgcttgtgaagggttgcctccagttttttgagtctggcagcctccccctctgtaagcttcttcaccgggattttcgtccatcccgacaccacatcggcaatctcgtcctctccgacggtctggtgatgccgtctgccgccctgttttgcctttgtattcagtttttccaacttttcttccagttcctggcgttttgcctgcgactccctcgccgtttccaggtctccgccggaaagtgcttcctccaatgtctcctgcaactccgcaatctcccgccggagttctgcagcctccttggggtctccgcccacatgaaggcgcacttttgccgcagcctcatccatcaggtcaatcgccttgtccgggaggaatcgatcgttgatgtaacgcgcggaaagacgcactgccgcctccacggcctcatccgtaatcgtcacatggtggtggctctcatactgcccacgcagtccctttaatatggaaatggcttcttcctccgtcggctcctccacaacgactggctggaaacgccgctccaaagctgcatctttttcgatatatttgcggtactcttcgatggtcgtcgcgccgatcacctgcacctcgcctctcgcaagtgcaggttttaaaatgttggatgcatcaatcgcgccttccgctccgcccgccccgatgatggtatgaatctcatcaatgaacagcaggacgtttccagctttcgccacctctgccagcaccttcttgatgcgctcctcaaattcacctctgtactttgagcctgccacaatcccggaaagatccagggaaaccactctttttccaagcaccgtatctggaaccattccgcccgcaatgcgctctgcgattccctctacaatcgccgtttttcctacgccgggttctccgatcaggcacggattgttcttgcttctccggcttaaaatctggatgacgcggtcgatctccgtctctctgccgaccaccggatcgagctttccggcgcgcgcaagttctgtcagatctctggaaaactgatccagcgccggcgttccctccgcatttctccgctttccgggttttccgttctggaattcatccttatactggcttacatcctcgcccatcgcgatcagggtgtccacatacattttctgcacattgacagacaatgtattcaacagtctggacgccacacattccgtctccttgatcatcgcaattaaaaggtgttctgttccaatcttctccgagtggaaacgcgccgcctccgctttggatacctcaagcacatgcgccgctctcggggacaatccgtcctccagaaccgcaaccgcattccccggtgcaatcagctcctcgatcagttccagcaccttatcatactctacaccattgtcggcaagtacctggcttgccacaccagttccctctttcaacaggccaagcagtatgtgctccgtgccgatataactgtgatgcaatgactttgatatccgcgttgcaatatcaatcgccttttttgcctttgctgtatatgctgtctgcatcgctacctcctatttccagtccgatatcacattcgtctttacagatcattaaaatctatgatatccagctcatcgtcttgcttgtttttctggtctttgccgcctgaaactttttctttttcatcgtccggcgcatcgctgtccccgtacgtgtcatcgtcatccccgtacgcgtcatcatccccatacgtgtcatcgtcatccccgtacgcgtcatcatcctcgtacgcgtcgtcatcatcaaacagatcgtcatccagatcgtcagacttccgcttccagaaaccgaatctcttcttcggcggctcttcctcctcgatgtcatcctcatcgaatgcatcatcgaacgcgtcatcgtcagattcctgcgttttcgttttctcttctctctcttcctgttcgtcgaattcatctgcatccccggcatctgcagcagagcgcttcttccagtgccactttttccgggaatccttttccggttcctcgatcacatcatcctggttttcatccagcagttcttctgtatcatcatgctctgagacaccgtcatccataatgtcatcctcatccaggtcatctctatccgcttccctcctgtgcagtaacaggttaacaagtaccactgccattaccgccagcagaaatatcaatatgccaatcgcggttctggaaaacgctttttcttttttatatttctcggacagcgccagatattcctcctgcagataggccgcatcctcgtcctgcagtccgtcggaagatacagttgtccctgtatttacgcgctgataggtctcctctatggagtcgtactggtaccagccttccgttccgtcagaattcactccgtaaaaggtatagaactccgattccacctcagacccttcctcctgggtctcctgatatgccgtcacaagacttccgtccgccagcgtaagctgtgtctgctgcatcgtatccggcatcgtataatccaccggtggcagaagcgctatcacatagtgttccccattgaccatttttacaaacggatacagggtatctcttgtgctgtcatatacaaagaagcttcctgtgctctcttccgctccgtcctgcaccagataaagcatgaccacagatcccttgtcataactcacgccccgataatccgccccctgataattgacggttgtctccgaaaaatctgcaggaacattctctgttgcaaaattttctgcaattacataggaaatgccatttgccgtaaccgtgttttcactgctgtccgtctcctctgttgtctccacttccccctcatcggatgccgttgtctctccggacgaggttccctgctttgtcacattcacggtataggttgcggtcacgccattttccgccttgactacaatcttaatggtgttatctccacttttcagattggtatttcccgtaaccgactccacgaccgctttttcattgaccggtgtggcagatacggcgatattggttacatcgcttcccactgtagcactataagtcagcgttttcccgttaaatgccggcgagagcgttcccgttgaaatggtcaactctttcagagaattatccgcagactgttttcctgttgtctctccagtattcgccgcagaatccccgtttccacccgctgatgttccgtttccgttggaggttccactgttactgctactattattgcctgaatctgtatttgtacttgctgcattctttactgtgaccgatgcactgctgcccgacatggaatccatctcctcattggagtcaaagatcactccgtcgttggcagagacagagagggaggaatttcccgcactcacagcttttaatgtcaccgtgtagctttctcccgtcgccatcacgcttccgccgcctccgccgtatgtggtattgcaactcacaaactgcagcacactcgaatcataagacagcgtcatggtcgcattcgccttttcgccggatggaccgctcgcttttactgtaactgtaaccgtatcaccgatattgacacttcctgacgacaccgagacagatgttgatccgctcgccgcgaataccgtctgcggcactccgacaaccccgaatgtcaggctaagcgccatcatcatcattgctatttttttcttcatttctgctctcccaattcttcctctcactgatcaatctgtgagattcccagtatgtgtttttgtaaaataaccagatccttattggaaataccgccgtccttgctgacgtttgccgcttccagacgactgccggactgactttcaattccaaggatctgtttctgcatcaataccagatccagattggaaacctttccgtcaccgttgatatctccatataccacaatctcatactgctgcacgagcgtgtcgccgacatacactgccagcttgttgcccgttcccaccgtctgtgtattctcactgccgtctgcattcagaatctttacggtacagttctgggttccgattcccgatgcgactgtggatgcgcttgttccaggctcaattcccgtcacataggttccgatcggataggatggcgtaatcgccgcgtcatccgccacctgaatggttccgccggcactgccccccgctcttgccacgatcagcgtgtaagtgcgcgaatctccgctctgcgagatgcaggtaatctgaatcgtattatctccataattcagcgaataatttccagtaccggaaacggttgacgttcccgccaccgccgtcgctcccacattgatcgaagccgcgctgtccggaacgaccagggaataggaggtattcgcaccggaaaatgccggtgtcagcgcatatccgtccaccgtgatcgaggaaagccagttgttcggattccccttgtccgcaaacgtcactgcgctctccggcatgttctgatagaccggaatgcggaaaacaaacgcctggttcttgtccgtgtaggcttttcccatattggtgccctcactcatcgccgcctgcacattggtcatgtactgatgtgcgtaaagactattggtatagacaacgttaaatttttcaaagtaaatggtattctgcccttttttcacataattatcagccacaaccgatgatccacccgcaatcgacttgtagatggagttccatccctgcaacttcgcatattccagtccgttcacaatcgccgacgcgctgcccgtcgtaaacgcacggacgttaaagtagttataatagcctgcatagttggaatatcgtcccgaaatcagatcgctcgtcccccgcacgccctgctcctgcttacagcgggatgccaggtggtaagggctcacgcccacattggagccgatctccacaaacgtatccgcatagctgcgaaccgctccgtccgtatcggtataattgcctgccataaatgtattggaaagaacgctctgcacacccgctgcgttctgatagcctgcatattccaacgtttcaaactgaaagatctgattctcgttaagaaaatttctgggatcgatgcagtatgcgatatattccggagacgccgacacccagcttgccccgtcaaacccgtaccacttgttggtctcccagttatacgcctgactgtccgtcgattttcttgcgtcattcacggaattctggatcaggtttcttccgaccagactctcattcgataccaccgtattccagtcaagtcccgtctgcaccggcacaaactgccagttcggatacttctgatgcagggatgccagtgcgctgcaatagcttgccggaaaacccgctgccgcaagcgccgcctcatactcgctgtccgtgacaccggtcgtctctccctgcgactggtcgtctgacgtctgaccgttcacggctacatagtccgcacaaatccacccggaataggaggcgcctccgaccacgagcgtcacactgtaccagttcattccgcccgccgagaccagctcgcccacattcacagcctgtcctttgtatacctttgtcaccacagagtaggacgttcccgctcccgagcgcacataaacacctttttccgtgttctgcaccaccccgtttgtcccacctgcactgctgtccgcattcgtctgtcccgcagaagaatccgtgccctgaagcgtcacaaaatccgagcgtatataaccggttacaccatccgacatctggatctggtaccatgtatacccgtctgatcctgccgtctcatcagttactgtcaccgcatttcccggatagagcagtgtcagcttatccccggtcaccggtgcgttgcgcaccttcaccggtccgtcattgatcgttcccgccgtcgccgtgtacgcatatacggcttcggggccgtgaaaagcagatatgctggcagcaagcactcccatgctgattgccgccagcaatatctttctcttctttctatatataaagtgattcatcgaattcctccctgagtaccgcacaagtccataaaatcatgcgcccaataattcagtctcattataggagattctatcacacgcgtcaacctaaatatagccattttcctgcacgctgtactatatttagacgtttttcgacatcaggttccggttctgtatcagcaggcttccccataatatgccccagagcccgcacacaattccggtgagcagtacagcattgcactcctgaaactggattccgaacagcagaaccacacccgtcaccagtccgaacgctccaatcgccgctataagcgcacacaaaagtatcaattccatatccactgttttcatcttcttatcctccttttctaacctgccagataccgttcccactcctgcttcgtcatccacggccagcacgccttgtcatcgatatagacgtccgcggagatttttctggattccgttccatactgttccaacgtctgcgccacattttcatttaccgcatcaaattccagtccgaacattctgcaccaggccaccgcctcctccagcagatccccgcagcggcatgtccacaaaattacttttttgccctgccttctcgcacccttgagcaatgcaaagagcggcagattcggcatcccgatggcaggataacattcactgcacaatgtcccgtcaaaatcgacggcaatgatctcgatctttttctccatgttcttccctccccatccgctttgatggtgtcagtatcgcacatgatgtgtccaattctttggacacttgttatgtaaacccatatttacaggacaaaaattgtcgcacgaagcatagacctctttggggtgataagtaatattatgagaagaccgcaccgtgggatttcagatggaaatgcaggtggaaattcggttcaaaaaatgtggcatttctaaccagccggatgtttgcatctgcgatgatccgtgtctttccaagtttggagcactccgcgggtcatgtccgcatcccggagacaatttgtaggactttcgtgtgtgtcccttattggcacctctgaacaaaacataaccgcgcgaagccgatgtctgagtcggcatctgccttattttcaatagcagatgccggcgagtttcggttcgcgcggttttatattgtctgtgaagaggtgccattagggacaccagaaagtccgcccattgtctccggtgtgccggacatgcacccgtcggattgtccaaacgtggaagagacacggaatccgatgcaaacattcagccggaagaaatgctcacatttttctccaacgaatttccatctgcatttccacatgaaatccccaagtgtgtttcctgtaatattacttatcaaaccaaagcacggtatgcttcgtgcgacacccccctttatctttatctctatacgatgtttttctgctatgcgttatacgccttcgccgtcaaacgccgggatgaagctctcttctgccgtctccccctcctgaataaatccctgctctacccccagtccgatcgcataatcgacgacctcctcatattcctcgtccgtgactttccggttcagctccgggtaggcgctgacattttccaacggcgtatactggttcatgatgctcagatatatctgattgccgtaggtttcatacaggtattttatcaccgccttagagtccctggtacagcccggcagcagcaggtgacgcacgataacgccctgtctcatcagaagtccctcctcgatcgggtcttctgcttcgtctccgtcaaacacgggtctcgggcactggcgcaccatctccgcaaccgccgctttggccacgtcggcataatccggagcgtgtgaatattttgcactgagcgccggacttatatatttaaagtccggcaggtagatatccacaagtccttccagacttttgatcgtatccgcactctcataactgctcgtattgtaaacgacgggaagccgcagtccttccttttttgcacggcgcaatgcctccgtaatctgcggtgcaaaatgtcccggcgtcaccagattgatattattcgcccctttttcctgcagttccaggaatatttctgccagacgctccttggtaatctcctttcctgccgtcccgtttgcgatgctacggttctggcagaacacacaatgcagggcacagccggagaaaaataccgcgccggagccgcttttcccggagatgcagggttcctcccagtaatgaagcgccgcacgcgcaaccttcagctgttcggtctgtccgcagatgccgcgctctccgcccgcacggtccactgcgcagtttctaggacacaatgtacacattttcatctttccgtccgtctctttctatctaaattcaatcttgataatcccgcgtattttgggtatgataatgtttgatttccgaaatgaccattttcggaacaatctgacattgatatatttacacataaggagttcgttatgaatcagaaaaattgtatggtagcccagtccggcggtcctaccgttgcgatcaacgcaagtcttgccggtgtcattgacggcgtgtccgcctcttccatgtacgacaccgtttacggctcgctcaacggaatcaccggtattttaaacgatgaccttctcaacctcacggagcttatggacggtcatccggaatatctttcccgccttgcgcagacacctgcgatgtacttaggctcctgccgctacaaacttccccattatctggatgatgattcaccctatgtcttcatatttaagcagtttgaaacttaccacattgaagcgtttttctatatcggcggcaatgattccatggacaccgtgttaaagctgtccgagtacggaaaacgcatcggcagttccgtccgcattatcggcatcccgaagaccatcgacaatgatctctgcgagaccgatcacaccccgggctttggctctgccgcaaaatacattgcctcctcgctcttagagatcgcgcacgacacctttatctacgcggtcaaaagcgtgaccatcgttgagatcatgggacgcgacgcaggatggctgaccgctgccgcggcactcgcgcgcaacggatacaacaccgccccgcacttaatctatctgccggaagtcgctttcgacccggaggatttccttttagacgtcaagcgtctccttttcgagcgcaacaatgtcatcgtcgcagtgtccgagggcatccgcgacgcctccggcaattacatcagcgcgtccgagcagtccatcgacacgttcggtcacagtcagttaagcggcgccggcaagacacttgagttccttgtcaaggaaaagcttggtgtcaaggtgcgttccgtggaaatcaatgtcctgcagcgctgtgccgcacatctggcttcccagacagacttagacgaatctttcgcactcggcaaaaaagccgtcgcactctccgaggagggtgtgacagcttccatggtcaccatcgagcgcacttcaaacgcaccgtataccgtggattactcctatgcggaaatccgccagatcgccaacgaggcaaagagcgttccgagagagtggatcaacagtgccggcaacgacatcgaacagcctctgctcgactatcttgctccgctgattcttggcgaatcgcaggtctcctatcacaacggtctgcctgtatacatggatgtgagccacctgtctaagcactagacaggtgctccctattcccggagcagaatctcgataaatttaccgatctcgacccacgcttttctggattccggcagcatctttgctgccatctggaaaatgtggaacatcccgtcatagatacttaagcgcacttttacgccctgtcctctcgccttcgcggcgacatccacagaatccgacaacagcatctcatacgatcccacctgtatcagcatcggcggaaatcctctgaaatcgccaaacatcggtgatatatattcatccatcgggtcgtggtctcccacataatcccgattgtagatcaggctgtccctggtctttccaaacaggggatccctctcgtagttggtatcgtaagactccccgcttgccgtcagatccgtccacggcgacatggcaatgattccgcacggaagctgtctgccgtgattgatcagatagtggcagagtgccatcgcaagtccgccgcccgccgaatctcccgccacaatgatctgctccgaaaaccatccctgcgcaagtagccattcatacgcgcacacggcatcctcgagcgccgccggatacggatgctccggtgccacgcggtaatccggcgtgagcacgctcatgccgtggctgacctcattgtacaatccggcaaacatgcggtatgcattgcgcatcgccccgacatatccgccgccgtgcagctgcaaaatgattttgtcgcggttcgcattctccttcgactctaaaagctccatggtaaaatgttccatctcgatcgtctgcatggtaaagcattccggacacttccacggaggttccgccgttccgatctgtttgcggagttccccattttttatctttttcccaatcagcaaatcattcgtcgtatgcgcgatcagatccctcacgactctgccgcggatactcgcctcattttctctcattcactgtacctctgttctattttccgctgtcagaaaacagctgcgccgccggacagcaaaacagccgcgtcagcggacatgaaatcttcgccgcagttccgtccttgccctccggtctcctatgatcagcgtacccaaaaacagtgccgtagaaaatgcaaacgccagcaaggcaagaagcggcgccgtcacgatccccaccgcatacaagaccagcgggacaacgctgcagagaatcataaaaatctgccacatcatgtagctctgccagttgcgccggttgatgcacatcagaatgagaattcccgcatccactaaaagaatggcggatggaagcgcatagttgacagaccagccgcggtaccccaccacgaagtcaatcgccacaaccatcaggatggcgatcagcgtcaacacgatgatcttgcccttgtagccggattttcccaatatggcatagcgcagcaccagatagccgtacaacatcgccagccccggaatcgcactccagaacatctccgagtcgctgagtacattcagatagatcaaaagcgcctccacaagaatcgccacgaacagatagatgcggctaagcaacgccagacgcctcgtcatcgtccgcacattcggatacatgttttccacctcaaccgtcttctccagcaccgaatggcaaagcggacagcgctccgtctcgtctaatatttccacattacattgcttgcatctactcataatttactccattcgtctctatctcaaccgcaatcccgtctgccgcgatttttctgaaaaaacctctctgcaccgacgtgtcggtcagatcataactgaaactgaataccagcgtatccccgtaggaacagatcgttccctttaagtgctgccctttggacatggcaagaaacgcatggaacatctccacataaggacgatactcctcgcttacggagatattcccgatattggtcaccgtcgctgtgtttgcaagcgcagaggttgtgtatacatagcgcatcgccagatttttcaaaaacagcggtacgatacgcgctgcaagaagcttctcattggagacattgtaggaaaaaagcttctccagattctcccggctgatctggctgcgcaggctctcactgacactttttagcacttcctcaaatgtatagatctcctttgtcggatgaaattctgccgacaccatcacaaagaaattcttcgtcgtgatcgaattaaaataagggcgcagattgaccggcaccgcaacacgaaccggacgttcggaaggcatcccgtgcatgcactccgtgtagacgctccagacatataccgccaccagatactcattgatgctgactccgtacgcatggcagactttcttcaactccgggatcttcatgtagccgtgcatgacgccgaactctcccggcggcagcttttctccctttaaaagatatgcccgcttcgtctgataccccttctgggagctgtgcttgtaattcttgaggaagctgtcctcacggttcaacgaggtatcactgctcaaggaatctcccaccttttcgcgcagcttcggatgtgccagccgcagatactgataggtcagctccttgagaaaattgatgccacccataccgtcggtgagcacatgaaatacttcgagattgatgcggtatttataataggttacgcggaacatataactgtggttcttattctgccggatatagcggcacggaaacgcactttcctcccgcacacgcggtgccggcttgccgttttcctcaaaataataccagaacacgccctggcgcagccgcagattaaacccatcaaacttcggcagcaccatatccagtgcctgctgcagcaattcacggtccaccagctccgtgagcgtcacgctgatgcggtatacattgctcatgctctccccggctatcaccggaaacaaatgcgccgtattgtccagacggtcccagcggatctccctctgtgcctctcttgcacggcgttttttcccttttacctggacagcttccttctgctcttcggccgctgttacctgatcctttttcttcatatattaaatgctcttttcctgtatagattctgttgcaattctgtcttacccgtagttccaatcttatcatacttcctattgtttgtccatgacacccacgcccgccattctttctaaaaatttcagactttatctcttgcattttattcgttttttttctaaaatatctgtgtggtatttggatataccagaaaagagaggctcacattatgttgtttaagaaattaagtgctccttctttaaaggagctttttgttgcagaattagagggaatgatattatccggaaagcttgagataggcgcaaaacttccgcctgagcgcgagcttgccgagtccatgcaggtatcgcgcgccgtcgtcaattccggtctggacgagatggagaaaaagggatttcttgtggtcaaaccacgaatcggcaccttcgttgccgactaccgcaaatacggtaccgcagacaccctagtctccatcatgcagtacaacggcggtatgctccgcgacaaggaagtgcgctccattctggaagtccgcatcatgttcatgaatcttgccgccacgctcgccatcgacaatgcggatgacgcgtccatcgccgggctcgagcagtatgtgaccgccttaaaggcatgcgaagatcctgaggaggctgcatcgctgatctttgacttcagccacgagctttccttcatcggcggcaattcgctgctcccgctgtttttcgcctccttcaaggatctggtgacaaacctgtgggtgcgcttcgccagcaagtacggcgcagcggcgctcgctgagagcgcggagcagattttcattcacgtgcgggaccgcgacaaagacgccgccatccgctatatcacggactccaccaacgaaagtattgacggctgccgccagatctatatgtaggcaccgcttccggtcagaataaatttttgacgtgctaagtaattgaagggagaatcattcctttccatttcaggcggaatgcatctggaaattcggatcaaaaaatgtggcatttctaaacaaccggtttttgcatctgcgatgatccgtgtttttccaagttttgagcactccacagaatgtgtccgcaatccgcagacaattttaggacttttttgtgtgtcccttatgggcacctctaaacataacataaccgcgcgaagccgctgtctgagccggcatctgccctgttttcaatagcagatgccggcgagttcggttcgcgcggttttatattgtctgtgaagaggtgcccttagggacaccagaaagtccgctcattgtctgcggtttgtcggacacattccgtggattgtcaaaacgtagaagagacacggaatccgatgcaaaaatccggtcggaagaaatgcacgcatttttttcaacgaatgttccatctgcatttccgcctgaaatcggttggatatgcctcttatcctattacttagcacgtcacactaatctatgacgtctttgcaaactggctgttatacagcttcgcatagaatccgttcttttccagaagttcctcgtgatttccctgctcaatgatgcttccatccttcatgaccagaatgatgtccgcctcgcggatcgtcgagagacggtgtgccacgataaaactggtgcgtccctgcatcatctttgcaaacgcattctgaatcttgatctcagtacgcgtatcaatcgaggatgtcgcctcatcaagaatcagcatcggaggcaggcacagcatgactcttgcaatgcataacagctgcttctgtccctgtgacaggttgccgccatcctctgcgatcacggtgtcatatccctccggcagacgcttgataaagccgtgtgcatgggatgcctttgcggccgcaatgatctcctcgtccgtggcgtccggttttcccatcgcaatgttgtcccggatgcttccgctccgaagccaggtctcctgcagcaccataccgtagttgtcccggagactcttgcgtgtcagctgctgcagcggaatatcgctgactttgattgtgccactgttcatatcatagaagcgcatcagcagattgatcaacgttgtcttgccgcatccggtcggtcccacgatcgccactcgctgtcccggcttcaccgacagattaaagtcctcaatcagcttctgctccggcacataggaaaaatagacatgtgaaagctcgaccttaccgtttgcatgctctaaatctaccgcgtcctcggcatccggcacctcggcatcctcctcaatcagctctatcactctgcccgcacacgcaagcgcattctgaagctccgtgatgacgcccgaaatctcgttgaacggcttcgtatactggttcgcgtaggacaaaagactcgacagctgtccgacactgatccctccggcaatcgccgaaaaagctccgacaactcctaccgttgcatagacaaggctgttgacaaaacgcgtcgacgggttggtaatactcgaaaagaaaatcgcccgcagagaatacttctgcagtctttcattgatctcatcaaacttctcaagcgcctcatcttcatgtgaaaatgcctgcaccactttctggttgccgaccatctcctcaataaacgccgtctgttctcccctcgtctctgactgcagcttgaacatggaaaatgtc

(The sequence listing continues in the following parts.)

The invention claimed is:

1. A pharmaceutical composition comprising a lyophilized bacteria strain of the genus *Roseburia* in a therapeutically effective amount for treating a disorder selected from the group consisting of Parkinson's disease, progressive supranuclear palsy, Steele-Richardson-Olszewski syndrome, normal pressure hydrocephalus, vascular parkinsonism, arteriosclerotic parkinsonism, drug-induced parkinsonism, Alzheimer's disease, Benson's syndrome, Huntington's disease, amyotrophic lateral sclerosis, Lou Gehrig's disease, motor neurone disease, prion disease, spinocerebellar ataxia, spinal muscular atrophy, dementia, Lewy body dementia, vascular dementia, frontotemporal dementia, primary progressive aphasia, mild cognitive impairment, HIV-related cognitive impairment, corticobasal degeneration, and stroke in a subject in need thereof,
  wherein said pharmaceutical composition contains only a single bacteria strain of the genus *Roseburia* and does not contain any other bacterial species or strain, and
  wherein said pharmaceutical composition is formulated in an enteric capsule for delivery to an intestine of said subject.

2. The pharmaceutical composition of claim 1, wherein said pharmaceutical composition comprises said bacteria strain in a therapeutically effective amount for treating a disorder selected from the group consisting of an early-onset Parkinson's disease, Alzheimer's disease, Huntington's disease, amyotrophic lateral sclerosis, Lou Gehrig's disease, motor neurone disease, prion disease, spinocerebellar ataxia, spinal muscular atrophy, dementia, primary progressive aphasia, mild cognitive impairment, HIV-related cognitive impairment, and corticobasal degeneration in said subject.

3. The pharmaceutical composition of claim 1, wherein said pharmaceutical composition comprises said bacteria strain in a therapeutically effective amount for delaying an onset or a progression of a disorder selected from the group consisting of Parkinson's disease, Alzheimer's disease, Huntington's disease, amyotrophic lateral sclerosis, Lou Gehrig's disease, motor neurone disease, prion disease, spinocerebellar ataxia, spinal muscular atrophy, dementia, primary progressive aphasia, mild cognitive impairment, HIV-related cognitive impairment, and corticobasal degeneration in said subject.

4. The pharmaceutical composition of claim 1, wherein said bacteria strain is of species *Roseburia hominis*, of species *Roseburia intestinalis*, or of species *Roseburia faecis*.

5. The pharmaceutical composition of claim 1, wherein said bacteria strain comprises a 16S rRNA gene sequence that has at least 95% sequence identity to the polynucleotide sequence of SEQ ID NO:3, as determined by a Smith Waterman homology search algorithm using an affine gap search with a gap open penalty of 12, a gap extension penalty of 2, and a Blocks Substitution Matrix (BLOSUM) of 62.

6. The pharmaceutical composition of claim 1, wherein said pharmaceutical composition comprises said bacteria strain in a therapeutically effective amount for treating Parkinson's disease in said subject.

7. The pharmaceutical composition of claim 1, wherein said pharmaceutical composition comprises said bacteria strain in a therapeutically effective amount for treating stroke in said subject, and
  wherein said stroke is selected from the group consisting of cerebral ischemia, focal cerebral ischemia, ischemic stroke, and hemorrhagic stroke.

8. The pharmaceutical composition of claim 1, wherein said pharmaceutical composition further comprises a pharmaceutically acceptable excipient, diluent, or carrier.

9. The pharmaceutical composition of claim 1, wherein said bacteria strain comprises a 16S rRNA gene sequence that has at least 97% sequence identity to the polynucleotide sequence of SEQ ID NO:3, as determined by a Smith Waterman homology search algorithm using an affine gap search with a gap open penalty of 12, a gap extension penalty of 2, and a Blocks Substitution Matrix (BLOSUM) of 62.

10. The pharmaceutical composition of claim 1, wherein said bacteria strain comprises a 16S rRNA gene sequence of SEQ ID NO:3, SEQ ID NO: 5, or SEQ ID NO:6.

11. The pharmaceutical composition of claim 1, wherein said bacterial strain is the strain deposited under accession number NCIMB 42383 or the strain deposited under accession number NCIMB 43043.

12. The pharmaceutical composition of claim 1, wherein said bacteria strain is capable of at least partially colonizing an intestine of said subject.

* * * * *